(12) United States Patent
Zitvogel et al.

(10) Patent No.: US 8,828,944 B2
(45) Date of Patent: Sep. 9, 2014

(54) COMPOUNDS AND USES THEREOF TO INDUCE AN IMMUNOGENIC CANCER CELL DEATH IN A SUBJECT

(75) Inventors: Laurence Zitvogel, Paris (FR); Guido Kroemer, Paris (FR); Nicolas Delahaye, La Hulpe (BE); Yuting Ma, Vitry sur Seine (FR); Oliver Kepp, Paris (FR)

(73) Assignee: Institut Gustave Roussy, Villejuif Cedex (FR)

( * ) Notice: Subject to any disclaimer, the term of this patent is extended or adjusted under 35 U.S.C. 154(b) by 0 days.

(21) Appl. No.: 13/642,221

(22) PCT Filed: Apr. 1, 2011

(86) PCT No.: PCT/EP2011/055134
§ 371 (c)(1),
(2), (4) Date: Oct. 19, 2012

(87) PCT Pub. No.: WO2011/131472
PCT Pub. Date: Oct. 27, 2011

(65) Prior Publication Data
US 2013/0052160 A1 Feb. 28, 2013

(30) Foreign Application Priority Data

Apr. 22, 2010 (WO) ................. PCT/EP2010/055404
Jul. 13, 2010 (WO) ................. PCT/IB2010/002034

(51) Int. Cl.
*A61P 35/00* (2006.01)
(52) U.S. Cl.
USPC ........................................ 514/19.3
(58) Field of Classification Search
None
See application file for complete search history.

(56) References Cited

U.S. PATENT DOCUMENTS 4,264,727 A * 4/1981 Kolehmainen et al. ........... 435/8
7,452,869 B2 * 11/2008 Hellner et al. ............... 514/44 R
2008/0027010 A1 * 1/2008 Khodadoust et al. .......... 514/26

FOREIGN PATENT DOCUMENTS

| EP | 1900375 | * 3/2008 | ............. A61K 38/17 |
| WO | WO 01/51638 | 7/2001 | |
| WO | WO 2006/133399 | 12/2006 | |
| WO | WO2008028968 | * 3/2008 | ............. G01N 33/50 |
| WO | WO 2009/052484 | 4/2009 | |

OTHER PUBLICATIONS

Apetoh et al., Immunogenicity of anthracyclines: moving towards more personalized medicine, Trends Mol. Med., 14, 141-151, 2008.*
Apetoh et al., Immunogenic chemotherapy: Discovery of a critical protein through proteomic analyses of tumor cells, Cancer Genomics & Proteom. 4, 65-70, 2007.*
Tesniere et al., Molecular characteristics of immunogenic cancer cell death, 15, 3-12, 2008.*
Prestwich et al., The immune system- is it relevant to cancer development, progression and treatment? Clin. Oncol., 20, 101-112, 2008.*
Tesniere et al., Immunogenic cancer cell death: a key-lock paradigm, Curr. Opin. Immunol. 20, 504-511, 2008.*
Obeid et al. Ecto-calreticulin in immunogenic chemotherapy, Immunol. Rev., 220, 22-34, 2007.*
Chaput et al., Molecular determinants of immunogenic cell death: surface exposure of calreticulin makes the difference, J. Mol. Med., 85, 1069-1076, 2007.*
Kepp et al., Immunogenic cell death modalities and their impact on cancer treatment, Apoptosis, 14, 364-375, 2009.*
Locher et al., Witch hunt against tumor cells enhanced by dendritic cells, Cancer Vaccines: Ann. N.Y. Acad. Sci. 1174: 51-60 2009.*
Zitvogel et al. Immunological aspects of cancer chemotherapy, Nature Rev. Immunol. 8, 59-73, 2008.*
Viey et al. Phosphostim-Activated γδ T Cells Kill Autologous Metastatic Renal Cell Carcinoma, J.Immunol., 174, 1338-1347, 2005.*
Zitvogel, L. et al. "The anticancer immune response: indispensable for therapeutic success?" *The Journal of Clinical Investigation*, Jun. 2008, pp. 1991-2001, vol. 118, No. 6.
Sellick, G. et al. "Scan of 977 nonsynonymous SNPs in CLL4 trial patients for the identification of genetic variants influencing prognosis" *Blood*, Feb. 1, 2008, pp. 1625-1633, vol. 111, No. 3.
Dai, Z. et al. "Genotyping panel for assessing response to cancer chemotherapy" *BMC Medical Genomics*, pp. 1-18, Jun. 11, 2008, vol. 1, No. 1.
Jarjanazi, H. et al. "Discovery of Genetic Profiles Impacting Response to Chemotherapy: Application to Gemcitabine" *Human Mutation*, 2008, pp. 461-467, vol. 29, No. 4.
Steffensen, K. D. et al. "Prediction of response to chemotherapy by ERCC1 immunohistochemistry and ERCC1 polymorphism in ovarian cancer" *International Journal of Gynecological Cancer*, 2008, pp. 702-710, vol. 18.
Written Opinion in International Application No. PCT/EP2011/055134, Sep. 28, 2011, pp. 1-15.

* cited by examiner

*Primary Examiner* — Elly-Gerald Stoica
(74) *Attorney, Agent, or Firm* — Saliwanchik, Lloyd & Eisenschenk

(57) ABSTRACT

The present invention relates to the fields of genetics, immunology and medicine. The present invention more specifically relates to in vitro or ex vivo methods for determining the susceptibility to a cancer treatment of a subject having a tumor. These methods comprise a step of determining the ability of the treatment, of the subject and/or of the tumor to induce an anticancer immune response, the inability of at least one of the treatment, the subject and the tumor to induce an anticancer immune response being indicative of a resistance of the subject to the therapeutic treatment of cancer. Inventors in particular identify genes specific of a human subject or of cancerous cells which can be used to predict or assess the sensitivity of a subject to a treatment of cancer. The invention also relates to particular compounds capable of activating or enhancing the immune system of a particular subject, when the subject is exposed to a therapeutic treatment of cancer or before such an exposition. It further relates to uses of such compounds, in particular to prepare a pharmaceutical composition to allow or improve the efficiency of a therapy of cancer in a subject in need thereof. The present invention in addition provides kits, methods for selecting a compound of interest, as well as pharmaceutical compositions and uses thereof.

2 Claims, 59 Drawing Sheets

C

D

C

Figure 1:
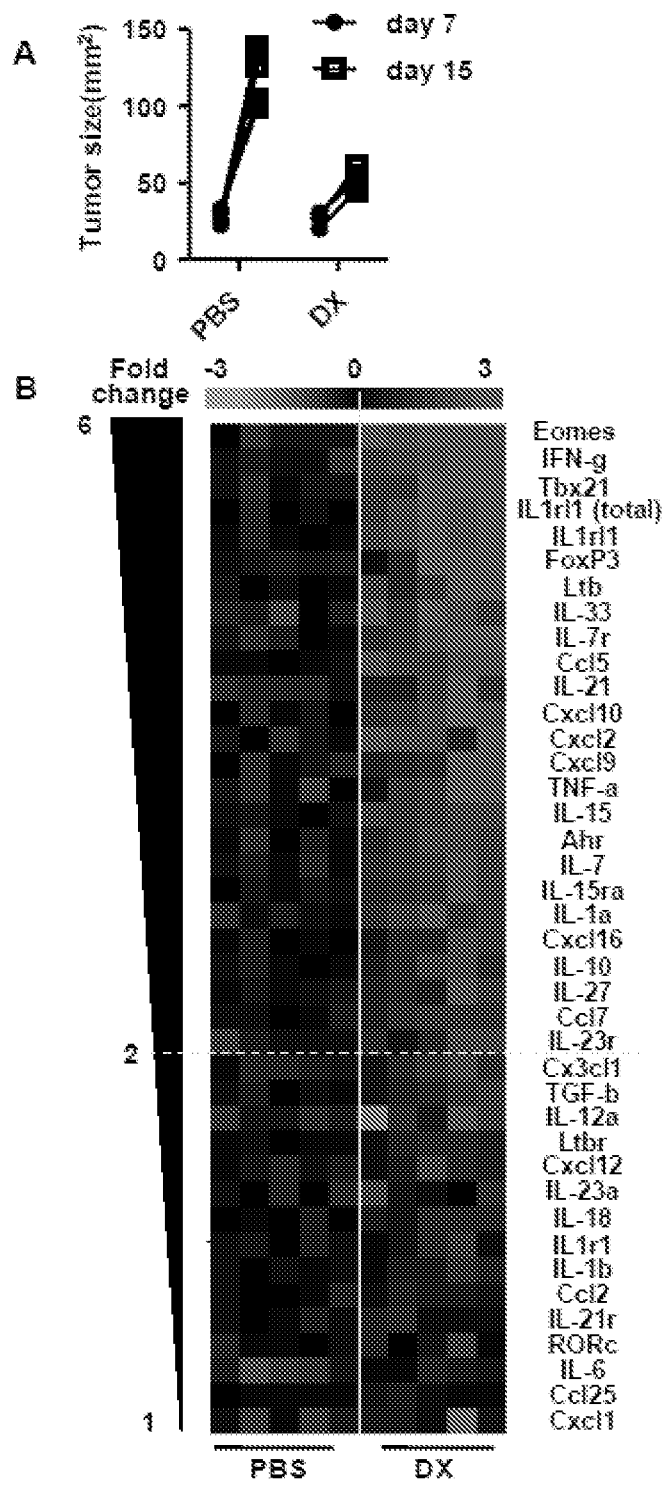
Figure 1:
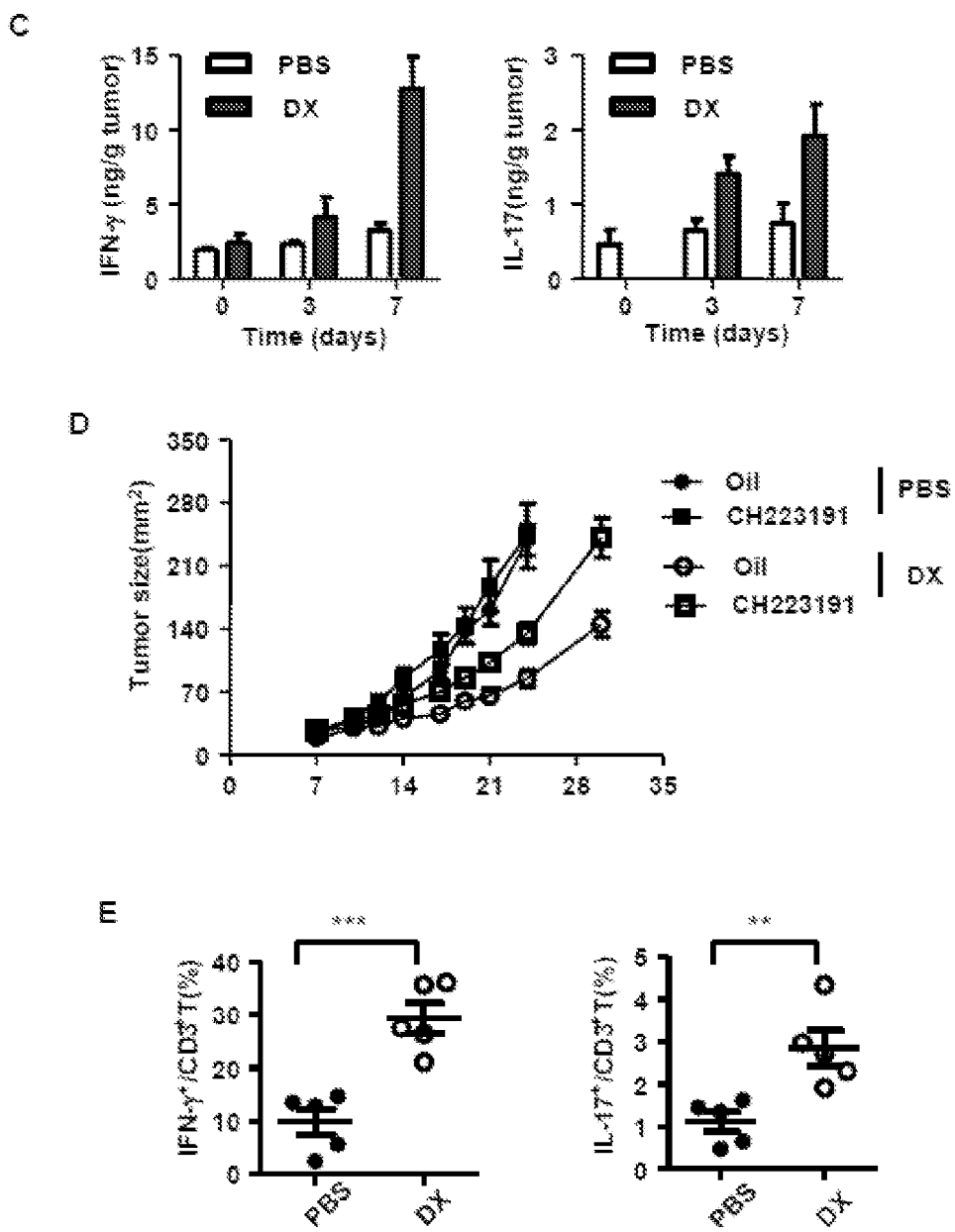

D pCR : Yes    Metastasis : No pCR : No    Metastasis : Yes

A

B

COMPOUNDS AND USES THEREOF TO INDUCE AN IMMUNOGENIC CANCER CELL DEATH IN A SUBJECT

CROSS-REFERENCE TO RELATED APPLICATION

This application is the U.S. national stage application of International Patent Application No. PCT/EP2011/055134, filed Apr. 1, 2011, the disclosure of which is hereby incorporated by reference in its entirety, including all figures, tables and amino acid or nucleic acid sequences.

The Sequence Listing for this application is labeled "SeqList-replace.txt" which was created on Dec. 16, 2013 and is 1,968 KB. The entire contents of the sequence listing is incorporated herein by reference in its entirety.

The present disclosure generally relates to the fields of genetics, immunology and medicine. The present invention more specifically relates to in vitro or ex vivo methods for determining the susceptibility to a cancer treatment of a subject having a tumour. These methods comprise a step of determining the ability of the treatment, of the subject and/or of the tumour to induce an anticancer immune response, the inability of at least one of the treatment, the subject and the tumor to induce an anticancer immune response being indicative of a resistance of the subject to the therapeutic treatment of cancer.

Inventors in particular identify genes specific of a human subject or of cancerous cells which can be used to predict or assess the sensitivity of a subject to a treatment of cancer.

The invention also relates to particular compounds capable of activating or enhancing the immune system of a particular subject, when the subject is exposed to a therapeutic treatment of cancer or before such an exposition. It further relates to uses of such compounds, in particular to prepare a pharmaceutical composition to allow or improve the efficiency of a therapy of cancer in a subject in need thereof.

The present invention in addition provides kits, methods for selecting a compound of interest, as well as pharmaceutical compositions and uses thereof.

BACKGROUND ART

Cancer is the major cause of mortality in most industrialized countries.

Although several anti-cancer therapies are proposed, amongst which feature chemotherapy [anthracyclines such as daunorubicine, doxorubicin (DX), idarubicin and mitoxantrone (MTX), as well as oxali-platinum (oxaliplatin or OXP), cis-platinum (cisplatin or CDDP), and taxanes (paclitaxel or docetaxel) are considered as the most efficient cytotoxic agents of the oncologist armamentarium] and radiotherapy [XR], the benefits of said treatments still tends to be insufficient.

Cytotoxic agents are supposed to directly destroy cancer cells by stimulating diverse cell death pathways. Nonetheless, several lines of evidence point to a critical contribution of the host immune system to the therapeutic activity mediated by tumoricidal agents (Zitvogel et al., 2008). Indeed, in some instances, the cell death modality triggered by chemotherapy or radiotherapy allows recognition of dying tumor cells by antigen presenting cells, thus eliciting a tumor-specific cognate immune response which is critical for tumor elimination.

However, most of standard chemotherapies induce a non-immunogenic apoptosis (Zitvogel et al., 2004; Steinman et al., 2004; Lake et al., 2006). Thus, even after an initially efficient chemotherapy, patients who do not develop an efficient antitumourous immune response are confronted to chemotherapy-resistant tumourous variants.

Inventors have shown for the first time that OXP and anthracyclines induce immunogenic cell death while other chemotherapeutic agents such as CDDP and alkylating agents tend to induce non-immunogenic cell death (Casares et al., 2005; Obeid et al., 2007). They have further observed that some patients were also resistant to treatments identified as inducing an immunogenic cell death. Solutions to detect dysfunctions responsible for an absent or reduced response to existing treatments as well as compounds usable to overcome said dysfunctions therefore appear critical for the patient and are herein advantageously provided by inventors.

SUMMARY

IL-17 (Interleukin 17), CRT (calreticulin), ATP (adenosine triphosphate), HMGB1 (High Mobility Group-B1), LysRS, IL-8 (Interleukin 8), ERp57 (thiol oxidoreductase of the endoplasmic reticulum), KDEL (-Lys-Asp-Glu-Leu-, SEQ ID NO: 530), TLR4 (Toll-like receptor 4), NALP3 (NLR Family, Pyrin Domain Containing 3 or Cryopyrin), IL-1b (Interleukin 1 beta), CCR1 (chemokine (C-C motif) receptor 1), EIF2AK2 (eukaryotic translation initiation factor 2-alpha kinase 2), DNAJC10 (DnaJ (Hsp40) Homolog, Subfamily C, Member 10), PDIA3 (Protein Disulfide Isomerase Family A, Member 3), (Eukaryotic Translation Initiation Factor 2A), PPP1CB (Protein Phosphatase 1, Catalytic Subunit, Beta Isozyme), IKBKB (Inhibitor Of Kappa Light Polypeptide Gene Enhancer In B-Cells, Kinase), PPP1CC (Protein Phosphatase 1, Catalytic Subunit, Gamma Isozyme), BAX (BCL2-associated X protein), AHR (aryl hydrocarbon receptor), MTHFR (methylenetetrahydrofolate reductase (NAD(P)H)) FAT2 (FAT atypical cadherin 2), DDX58 (DEAD (Asp-Glu-Ala-Asp, SEQ ID NO: 531, box polypeptide 58) (RIG-1), CX3CR1 (C-X3-C motif chemokine receptor 1), NLRP4 (NACHT, LRR and PYD domains-containing protein 4), MCA205 (Mouse sarcoma cells), RT-PCR (Reverse Transcriptase-Polymerase chain reaction), ELISA (enzyme-linked immunosorbent assay), DMSO (dimethylsulfoxide), CD45.2+ (Cluster of Differentiation 45.2+), CD3+ (Cluster of Differentiation 3+), TILs (Tumor-infiltrating lymphocytes), DX (doxorubicin), PBS (Phosphate Buffered Saline), IFN-γ+ (Interferon gamma), CD4+ (Cluster of Differentiation 4+), CD8+ (Cluster of Differentiation 8+), TCR (T Cell Receptor), SEM (Standard error of mean), OVA (Ovalbumine), LN (Lymph nodes), GFP (Green Fluorescent Protein), U2OS cells (cells from human osteosarcoma U2OS cell line), LOOCV (leave-one-out cross validation), SVM (Support Vector Machines), ROC (Receiver Operating Characteristic), IgA (Immunoglobulin A), IgG (Immunoglobulin G), BC (Breast Cancer), FFPE (Formalin-Fixed, Paraffin-Embedded), Vd2 T lymphocyte (Vd2 (circulating) T lymphocytes, γδ T17 cells (Interleukin-17 producing γδ T lymphocytes), LC3 (microtubule-associated protein 1 light chain 3), Tc1 (Tc1 cells, interferon-γ producing CD8+ T lymphocytes)), and NAC (N-Acetyl-L-cysteine).

The present invention is based on the observation by inventors that the cell death immunogenicity depends on the lethal stimulus, on the presence of specific signals produced by or exposed on tumor cells, as well as on the ability of the subject having the tumor, and in particular of the subject's immune system, to recognize said signals.

The present invention provides an in vitro or ex vivo method of assessing the sensitivity of a subject having a tumor to a treatment of cancer (in other words of determining susceptibility of a patient having a tumor to respond to a treatment of cancer), which method comprises a step of detecting the presence of an anticancer immune response of the subject undergoing the treatment of cancer, the absence of an anticancer immune response being indicative of a resistance of the subject to the treatment of cancer.

The method may be applied before and/or after exposition of the subject to the treatment of cancer. In a particular embodiment, the therapeutic treatment of cancer is a conventional immunogenic treatment of cancer selected from a chemotherapy using a drug selected from an anthracyclin, a platin, a taxane and an antimitotic agent, preferably from an anthracyclin, a platin, and an antimitotic agent; and radiotherapy.

The presence of cells selected from IL-17 producing γδ T lymphocytes, dendritic cells and cytotoxic T lymphocytes, in the tumor of the subject may in particular be indicative of an anticancer immune response and of a sensitivity of the subject to the treatment of cancer.

As well, the appearance of anti-CRT antibodies in a sample, typically a serum sample, of a subject after a first exposition of the subject to a treatment of cancer, and preferably an increase of said anti-CRT antibodies during said treatment, may be indicative of an anticancer immune response and of a sensitivity of the subject to said treatment of cancer.

In vitro or ex vivo methods of assessing the sensitivity of a subject having a tumor to a treatment of cancer are further herein described. These methods comprise a step of determining the ability of the treatment, of the tumor and/or of the subject to induce an anticancer immune response, the inability of at least one of the treatment, the subject and the tumor to induce an anticancer immune response being indicative of a resistance of the subject to the treatment of cancer.

The presence, in the subject, of an alteration leading to the abnormal expression of an immune gene, as herein described, may in particular determine the inability of the subject to induce an anticancer immune response. The alteration may be a single nucleotide polymorphism (SNP).

The step of determining the ability of the tumor to induce an anticancer immune response may in particular consist in verifying the expression by tumor cells of an immunogenic cell death marker selected from a protein allowing or enhancing CRT exposure at the surface of tumor cells, and a protein expressed during the endoplasmic reticulum (ER) stress response and/or during the macroautophagic response of the subject's immune system.

A method of selecting an optimal therapeutic treatment of cancer in a subject having a tumor is in addition herein described. This method comprises a step as previously described of assessing the sensitivity of the subject to a first treatment of cancer (herein also identified as "conventional treatment") and, if the subject is resistant to said first treatment of cancer, a step of selecting a "compensatory molecule", to be used, alone or in combination with the first treatment of cancer as the optimal therapeutic treatment of cancer for the subject.

A particular method of selecting an optimal therapeutic treatment of cancer in a subject having a tumor is a method comprising a step of assessing the sensitivity of the subject to a first treatment of cancer with a method as herein described, and, if the subject is resistant to said first treatment of cancer, and a step of selecting (i) a product allowing or enhancing the secretion of ATP, HMGB1, LysRS and/or IL-8, and/or the exposure of CRT, ERp57, LysRS and/or KDEL receptor at the surface of a tumour cell, (ii) a product stimulating the autophagy machinery and/or an ER stress response, (iii) a product recruiting and/or activating IL-17 producing γδ T lymphocytes, cytotoxic T cells and/or dendritic cells, (iv) a product promoting activation of the TLR4/myd88 pathway, or able to bypass said pathway, (v) a product triggering the P2RX7 (P2X purinoceptor 7) and/or the NALP3 inflammasome, (vi) a product allowing or enhancing the secretion of IL-1b, (vii) a product capable of stimulating intratumoral Vd2 T lymphocytes, and (viii) a product selected from an anti-allergic drug, a neurotropic drug, an antihypertensive or cardiotropic drug such as a cardiac glycoside, a spindle poison drug, an antimicrobial drug, an anti-osteoclastic drug, a diuretic drug, an oestrogen, an apyrase inhibitor (or ecto-ATPase inhibitor), and (ix) any combination thereof, to be used in combination with the first treatment of cancer as the optimal therapeutic treatment of cancer for the subject.

Also herein described are compensatory molecules for use in the treatment of cancer, preferably in combination with a conventional treatment of cancer, in particular a chemotherapeutic treatment of cancer, in a subject identified, by a method as previously described, as resistant to a conventional treatment of cancer.

The present invention further encompasses the use of such a compensatory molecule to prepare a pharmaceutical composition for treating a cancer in a subject identified, by a method as previously described, as resistant to a conventional treatment of cancer, as well as the corresponding pharmaceutical composition. Preferably, the pharmaceutical composition further comprises, as a combined preparation, a drug used in a conventional treatment of cancer, for simultaneous, separate or sequential use in the treatment of said cancer.

The present invention in particular encompasses a drug selected from (i) a product allowing or enhancing the secretion of ATP, HMGB1, LysRS and/or IL-8, and/or the exposure of CRT, ERp57, LysRS and/or KDEL receptor at the surface of a tumour cell, (ii) a product stimulating the autophagy machinery and/or an ER stress response, (iii) a product recruiting and/or activating IL-17 producing γδ T lymphocytes, cytotoxic T cells and/or dendritic cells, (iv) a product promoting activation of the TLR4/myd88 pathway, or able to bypass said pathway, (v) a product triggering the P2RX7 (P2X purinoceptor 7) and/or the NALP3 inflammasome, (vi) a product allowing or enhancing the secretion of IL-1b, (vii) a product capable of stimulating intratumoral Vd2 T lymphocytes, and (viii) a product selected from an anti-allergic drug, a neurotropic drug, an antihypertensive or cardiotropic drug such as a cardiac glycoside, a spindle poison drug, an antimicrobial drug, an anti-osteoclastic drug, a diuretic drug, an oestrogen, an apyrase inhibitor (or ecto-ATPase inhibitor) and (ix) any combination thereof, for use in a treatment of cancer, preferably in combination with a conventional immunogenic treatment of cancer selected from a chemotherapy using a drug selected from an anthracyclin, a platin, a taxane and an antimitotic agent, preferably from an anthracyclin, an oxaliplatin, a taxane and an antimitotic agent; and radiotherapy, in a subject identified as resistant to said conventional immunogenic treatment of cancer according to a method as herein described of assessing the sensitivity of a subject having a tumor to a therapeutic treatment of cancer.

Induction of immunogenic cancer-cell death, using a compensatory molecule as herein described, allows the subject's immune system, thanks to the present invention, to contribute, through a "bystander effect", to the eradication of cancer cells and cancer stem cells which are resistant to conventional therapeutic treatments.

Herein described is also a method of treating cancer comprising the administration to a subject in need thereof, as previously explained, of a compensatory molecule, preferably together with a drug used in a conventional treatment of cancer (as a combined preparation).

Further herein described are the following kits:

A kit to detect the abnormal expression, in particular in a tumor biopsy, of a gene selected from CCR1, EIF2AK2, DNAJC10, PDIA3, EIF2A, PPP1CB, IKBKB, PPP1CC, BAX and combinations thereof, in a tumor sample of the subject, the kit comprising (i) at least one pair of primers and (ii) at least one fluorescent probe, for example two different probes, allowing the quantitative detection of the expression of a gene selected from CCR1, EIF2AK2, DNAJC10, PDIA3, EIF2A, PPP1CB, IKBKB, PPP1CC, BAX, and (iii) a leaflet providing the control quantitative expression values corresponding to at least one of said genes in a control population.

A kit to detect the presence of a polymorphism associated with an abnormal expression of a gene selected from AHR and MTHFR (for example a kit to detect the presence of a polymorphism associated with an abnormal expression of such a gene), in a tumor or blood sample of the subject, the kit comprising (i) at least one pair of primers, and (ii) at least two differently labelled probes, the first probe recognizing the wild-type allele and the second probe recognizing the mutated allele of a gene selected from AHR and MTHFR.

A kit to detect the presence of a polymorphism associated with an abnormal expression of a gene selected from FAT2 and MTHFR (for example a kit to detect the presence of a polymorphism associated with an abnormal expression of such a gene), in a tumor or blood sample of the subject, the kit comprising (i) at least one pair of primers, and (ii) at least two differently labelled probes, the first probe recognizing the wild-type allele and the second probe recognizing the mutated allele of a gene selected from FAT2 and MTHFR.

A kit to detect the presence of a polymorphism associated with an abnormal expression of a gene selected from DDX58 (RIG-1) and CX3CR1 (for example a kit to detect the presence of a polymorphism associated with an abnormal expression of such a gene), in a tumor or blood sample of the subject, the kit comprising (i) at least one pair of primers, and (ii) at least two differently labelled probes, the first probe recognizing the wild-type allele and the second probe recognizing the mutated allele of a gene selected from DDX58 and CX3CR1.

A kit to detect the presence of a polymorphism associated with an abnormal expression of a NLRP4 gene (for example a kit to detect the presence of a polymorphism associated with an abnormal expression of such a gene), in a tumor or blood sample of the subject, the kit comprising (i) at least one pair of primers, and (ii) at least two differently labelled probes, the first probe recognizing the wild-type allele and the second probe recognizing the mutated allele of the NLRP4 gene.

A kit comprising:
a. (i) at least one pair of primers, (ii) at least one fluorescent probe allowing the quantitative detection of the expression of a gene selected from CCR1, EIF2AK2, DNAJC10, PDIA3, EIF2A, PPP1CB, IKBKB, PPP1CC and BAX and (iii) a leaflet providing the control quantitative expression values corresponding to at least one of said genes in a control population; and
b. (i) at least one pair of primers, and (ii) at least two differently labelled probes, the first probe recognizing the wild-type allele and the second probe recognizing the mutated allele of a gene selected from NLRP4, FAT2 and MTHFR (for neoadjuvant therapy) or TLR4, P2RX7, DDX58 (for adjuvant therapy).

A kit comprising:
a. several antibodies for immunohistochemistry usage recognizing the core protein machinery of ER stress and autophagy in tissue sections (paraffin embedded- or frozen) such as phosphorylated eif2a, ERp57, calreticulin, HMGB1, LC3 gate 16 GABARAP (gamma-aminobutyric acid receptor-associated protein); and
b. (i) at least one pair of primers, and (ii) at least two differently labelled probes, the first probe recognizing the wild-type allele and the second probe recognizing the mutated allele of a gene selected from NLRP4, FAT2 and MTHFR (for neoadjuvant therapy) or TLR4, P2RX7, DDX58 (for adjuvant therapy).

FIGURES

FIG. 1. Th1 and Th17 related genes expression in tumors post-chemotherapy.

(A) MCA205 tumors were treated with Doxorubicin (DX) or PBS. Tumor growth was monitored before and 8 days post-chemotherapy.

(B) Gene expression in DX versus PBS group was tested by RT-PCR (Taqman) and shown as fold change 8 days after treatment (lower panel). A more than 2 fold change was used as threshold for significant differences.

(C) Measurements of protein levels of IFN-γ and IL-17 in tumor homogeneates by ELISA at different time points.

(D) AHR antagonist CH223191 was dissolved with DMSO and diluted in Olive Oil. Mice treated with either PBS or DX received a daily i.p. injection of CH223191 (2 mM, 100 µl) for 4 days starting from the day of DX (or PBS) treatment.

(E) Expression of IFN-γ and IL-17 in dissociated tumor beds was tested by intracellular staining gated on live, CD45.2$^+$ and CD3$^+$ cells at day 8 post-treatment. Each group contained at least 5 mice and each experiment was performed at least twice yielding identical results.

Each graph depicts means±SEM of tumor sizes (A, D) or protein expression (C) or percentages of positive cells (E). *p<0.05, p<0.01, *p<0.001.

Figure 2:
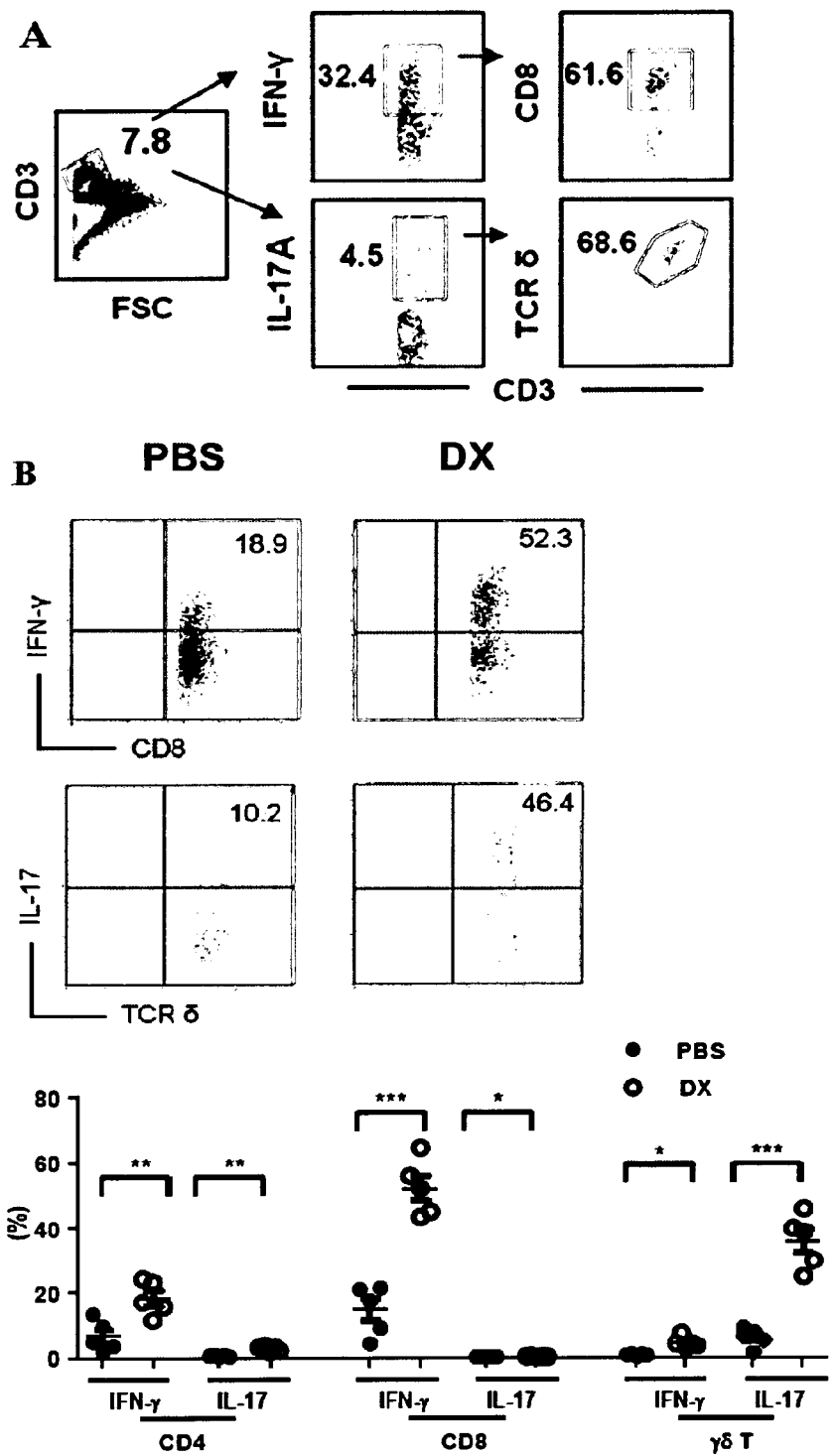
Figure 2:
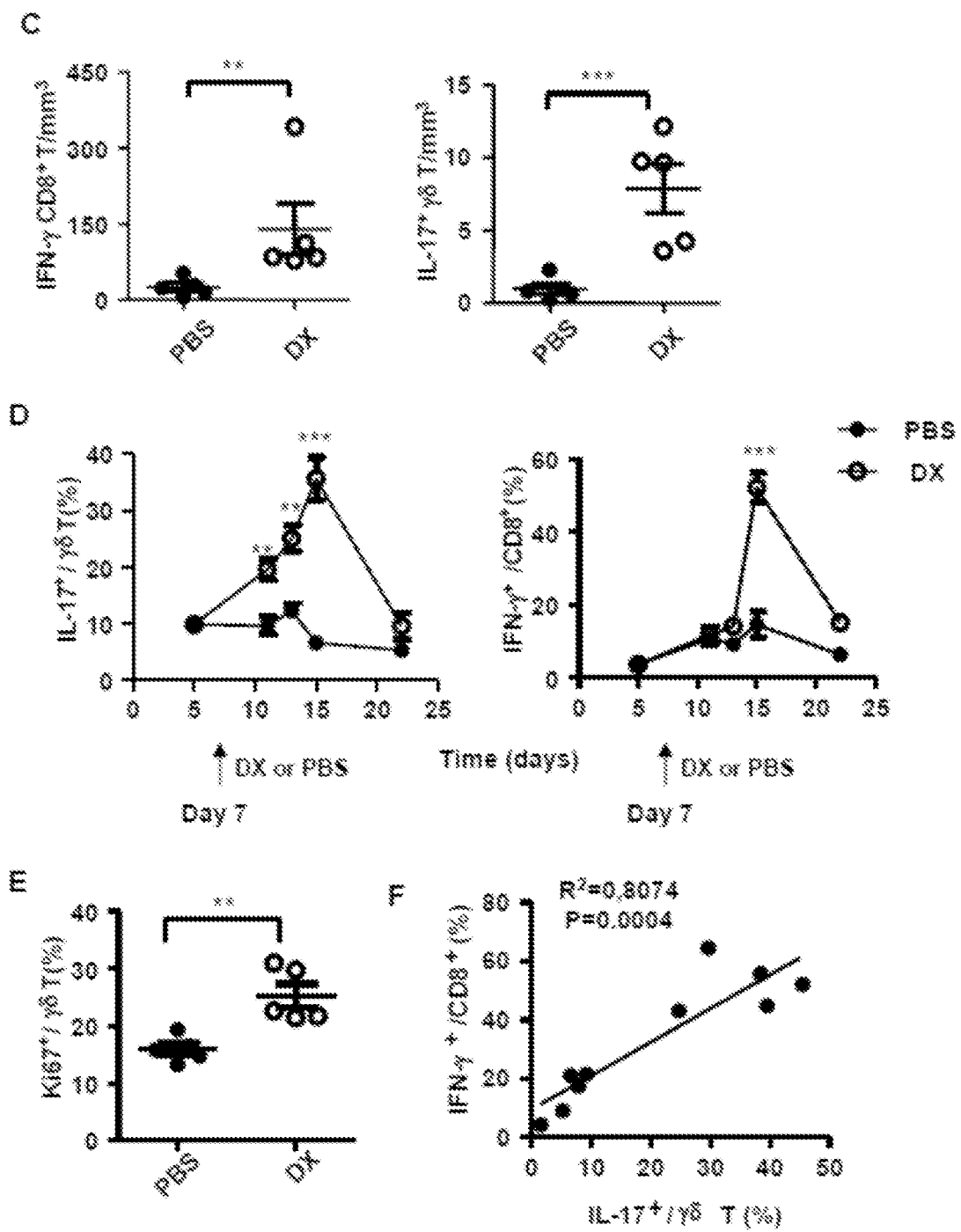

FIG. 2. CD8$^+$ T cells and γδ T cells are the major sources of IFN-γ and IL-17 respectively post-chemotherapy.

(A) Single cell suspensions of MCA205 tumors (day 8 post-DX) were analyzed by flow cytometry. IFN-γ and IL-17 positive cells were gated within live CD45.2$^+$ and CD3$^+$ cells (TILs). Within this gate, the proportions of CD3$^+$ CD8$^+$ cells and CD3$^+$ TCR δ$^+$ cells were examined. A typical dot plot analysis is shown.

(B) A typical dot plot in one DX or PBS treated tumor showing IFN-γ production by CD8 and IL-17 production by γδ T is depicted (upper panel). The percentages of IFN-γ$^+$ and IL-17$^+$ T cells among CD4$^+$, CD8$^+$ and TCRδ$^+$ TILs in PBS versus DX-treated tumors are indicated as means±SEM of 5 tumors per condition (lower panel).

(C) Absolute numbers of IFN-γ$^+$ CD8$^+$T cells and IL-17$^{+γδ\ T\ cells\ per}$ 1 mm$^3$ of tumor are indicated as means±SEM in 5 tumors treated with DX or PBS.

(D) Kinetic study of IL-17 and IFN-γ production by γδ T and CD8$^+$ T cells respectively analyzed by flow cytometry in tumors treated with PBS or DX.

(E) Ki67 expression on γδ TILs 8 days after DX showed as means±SEM in 5 tumors treated with DX or PBS.

(F) Correlation between the percentages of γδ T17 and Tc1 TILs in all tumors (treated or not) was plotted for MCA205 sarcomas (each dot representing one tumor). *p<0.05, p<0.01, *p<0.001.

Figure 3:
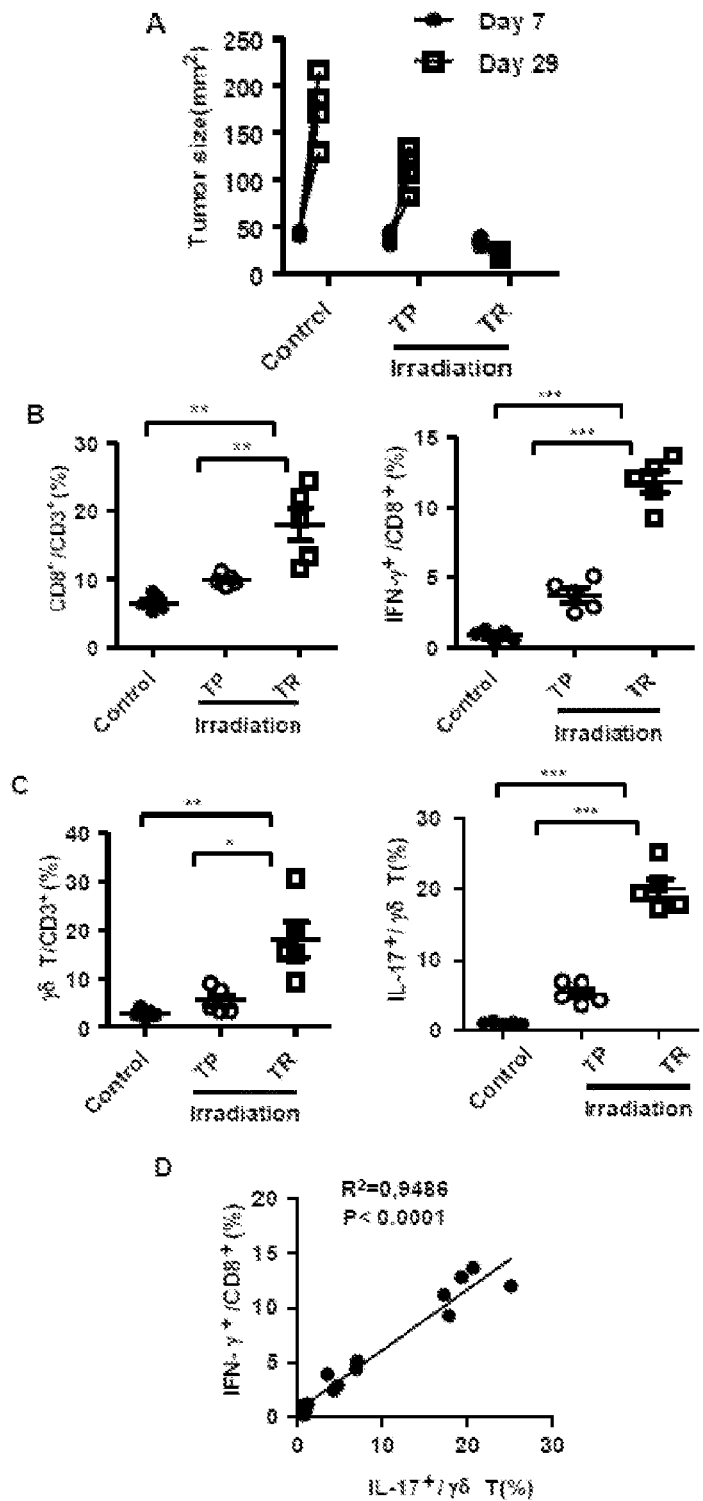

FIG. 3. Recruitment of both Tc1 and γδ T17 cells correlate with better outcome in radiotherapy of TS/A tumors.

(A) Established TS/A tumors were treated with local irradiation on day 7. Mice were segregated into responders and non responders according to their tumor regression (TR) or tumor progression (TP) after radiotherapy (n=5).

(B) Percentages of CD8$^+$ T cells and Tc1 among CD3$^+$ TILs are indicated as means±SEM.

(C) Percentages of γδ T and γδ T17 cells among CD3$^+$ TILs are indicated as means±SEM.

(D) Correlation between the percentages of γδ T17 and Tc1 TILs in all tumors (treated or not) was plotted for TS/A mammary cancers (each dot representing one tumor).

*p<0.05, p<0.01, *p<0.001.

Figure 4:
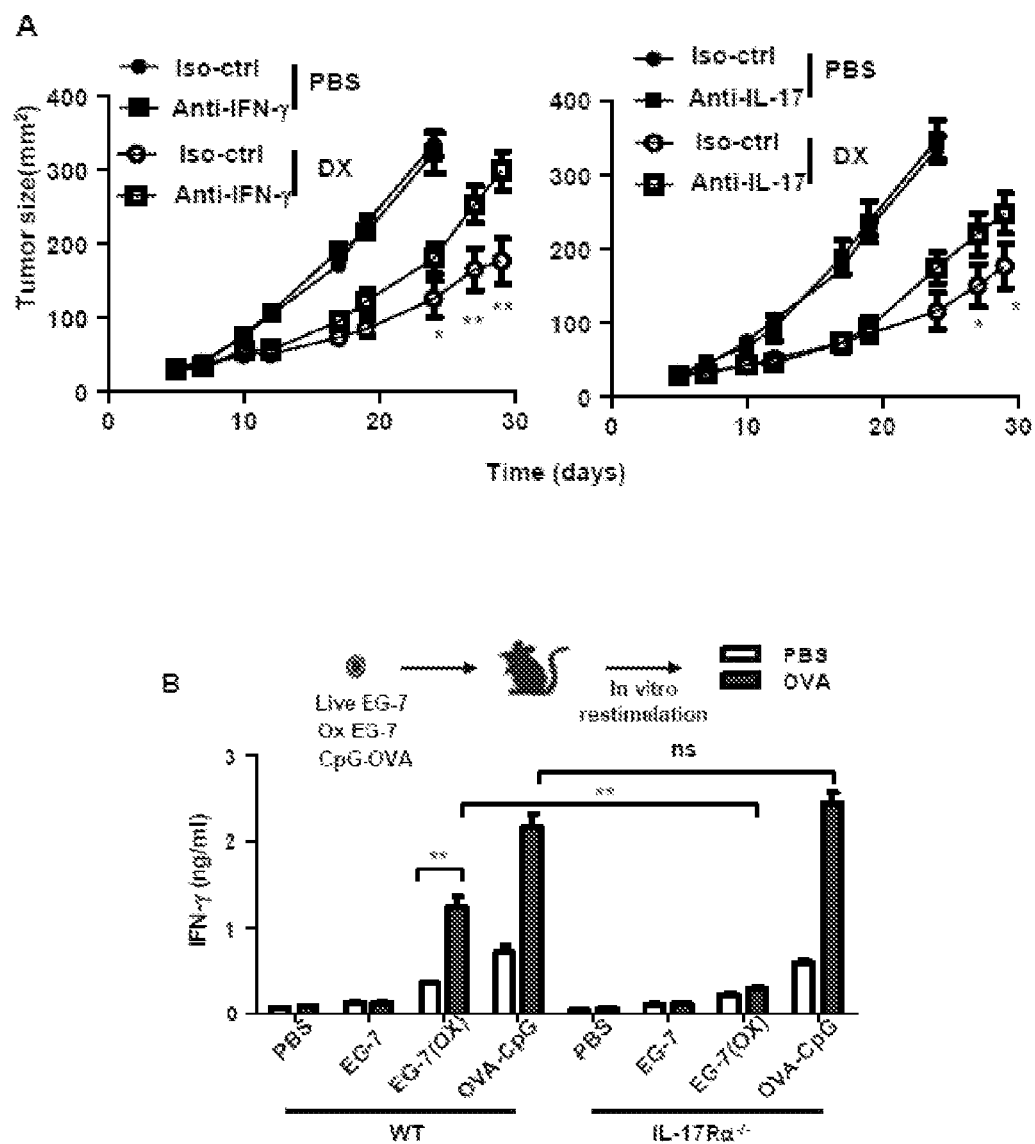
Figure 4:
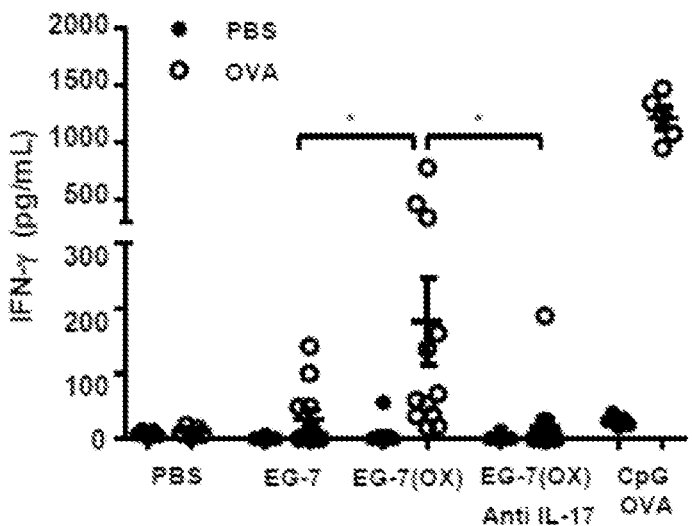
Figure 4:
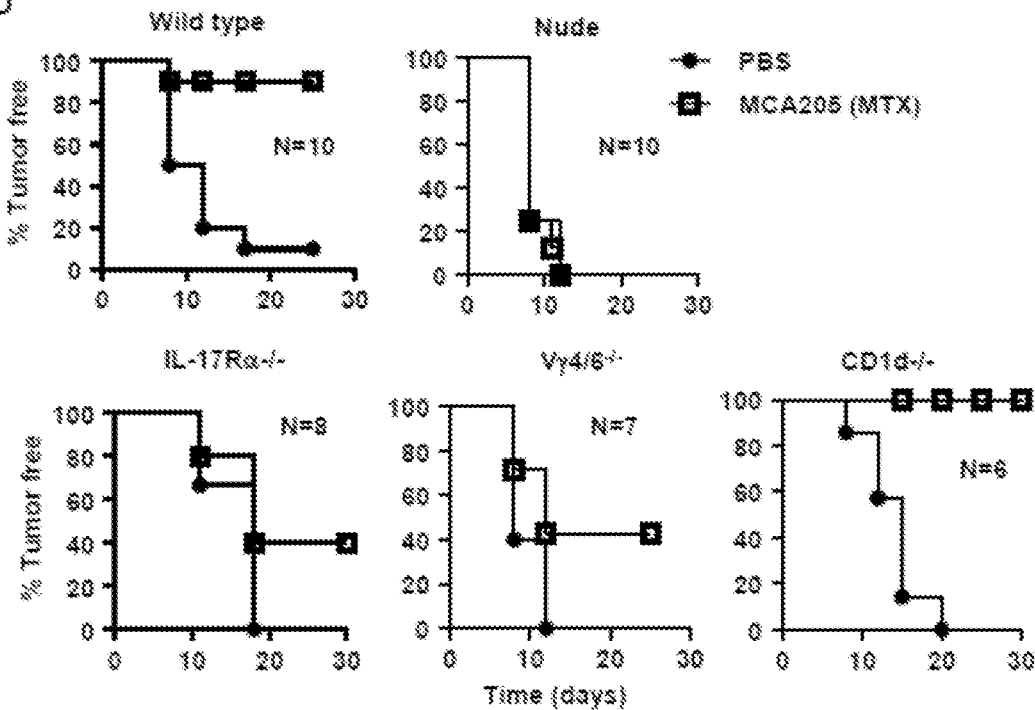

FIG. 4. IL-17 contributes to prophylactic and therapeutic responses to immunogenic chemotherapy.

(A) Role of IFN-γ and IL-17 in DX-mediated anti-tumor effects. Mice bearing established MCA205 sarcoma were treated with local DX and systemic neutralizing antibodies (against mouse IFN-γ (left panel) or IL-17 (right panel) or isotype control (Iso ctrl) i.p. every 2 days (3 injections total) starting from the day of DX. Tumor sizes are plotted as means±SEM for 5 mice/group. The experiment was performed twice with identical results.

(B-C) Role of IL-17/IL-17Rα signaling pathway in the immunogenicity of cell death. Oxaliplatin (OX)-treated EG-7 cells were inoculated in the footpad of WT versus IL-17Rα$^{-/-}$ mice (n=5) (B) or into WT mice along with anti-IL-17 neutralizing Ab (or isotype Ctrl Ab) (C) and OVA-specific IFN-γ secretion was measured in the draining lymph nodes.

(D) Immunization with DX-treated MCA205 and rechallenge with a tumorigenic dose of live MCA205 were performed at day 0 and day 7 respectively in mouse with various genetic backgrounds (as indicated). The percentages of tumor free mice were scored at different time points. A representative experiment out of two is depicted including 6-10 mice/group.

*p<0.05, **p<0.01.

Figure 5:
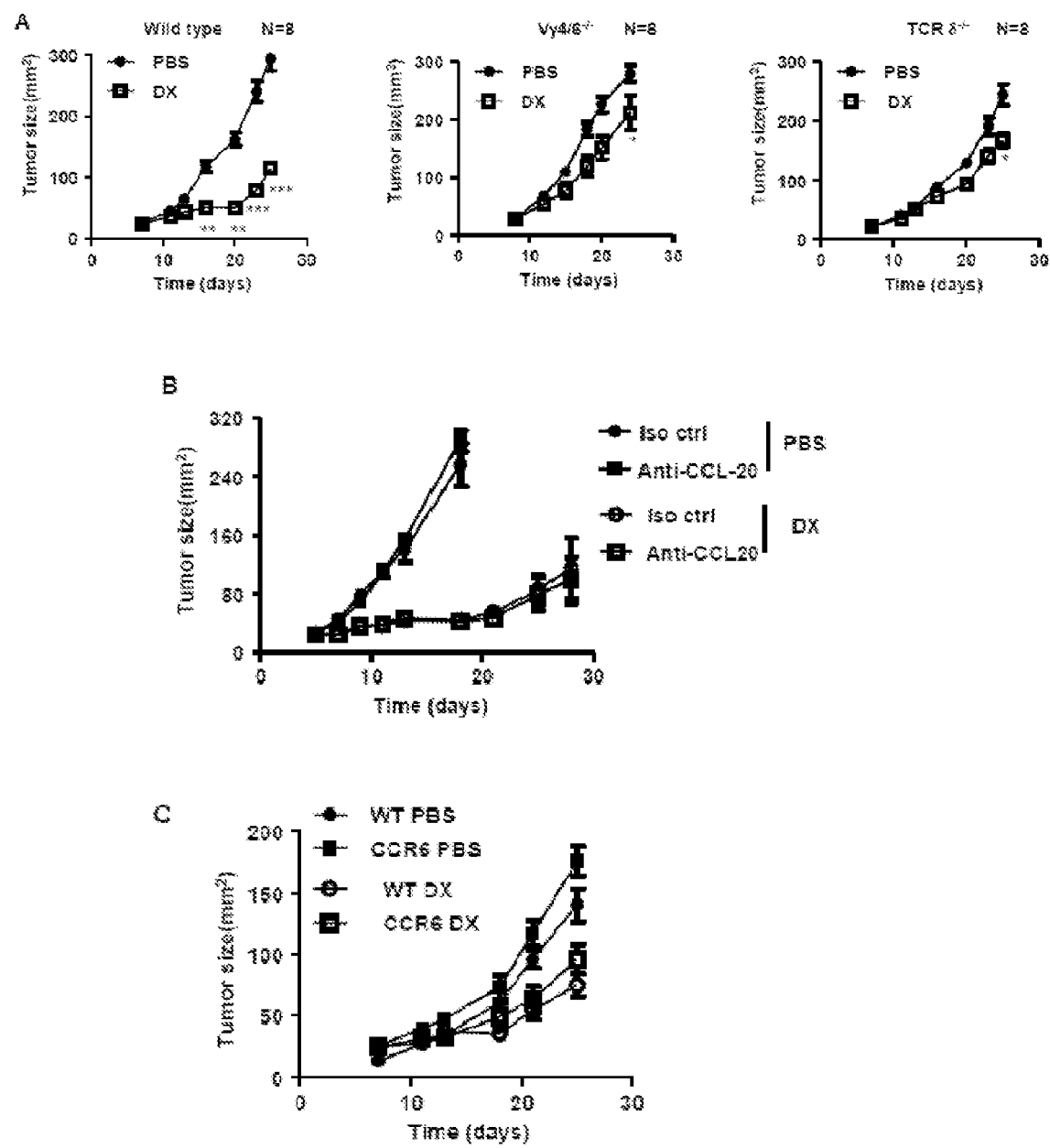

FIG. 5. The therapeutic activity of anthracyclines depended upon Vγ4/6γδ T cells.

Established MCA205 were treated locally with DX in various genetic backgrounds (A, C) or in WT mice in addition to systemic administration of neutralizing antibodies anti-CCL20 (or isotype Ctrl Ab) (B).

*p<0.05, p<0.01, *p<0.001.

Figure 6:
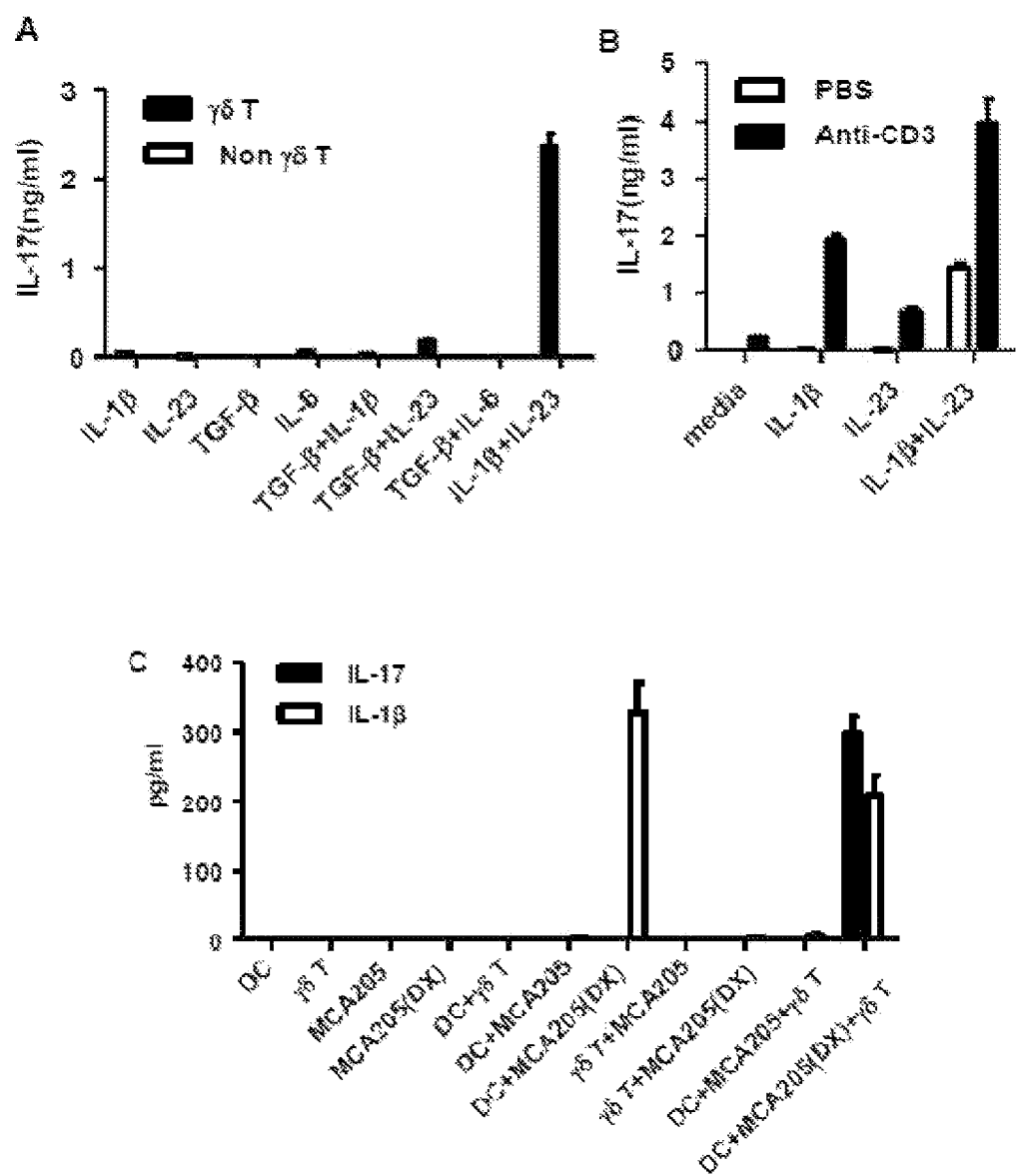
Figure 6:
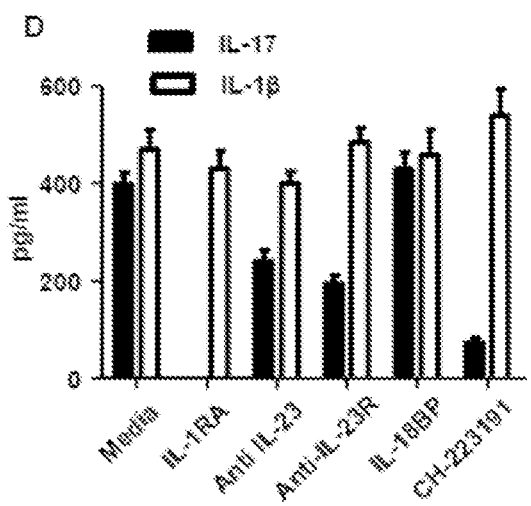
Figure 6:
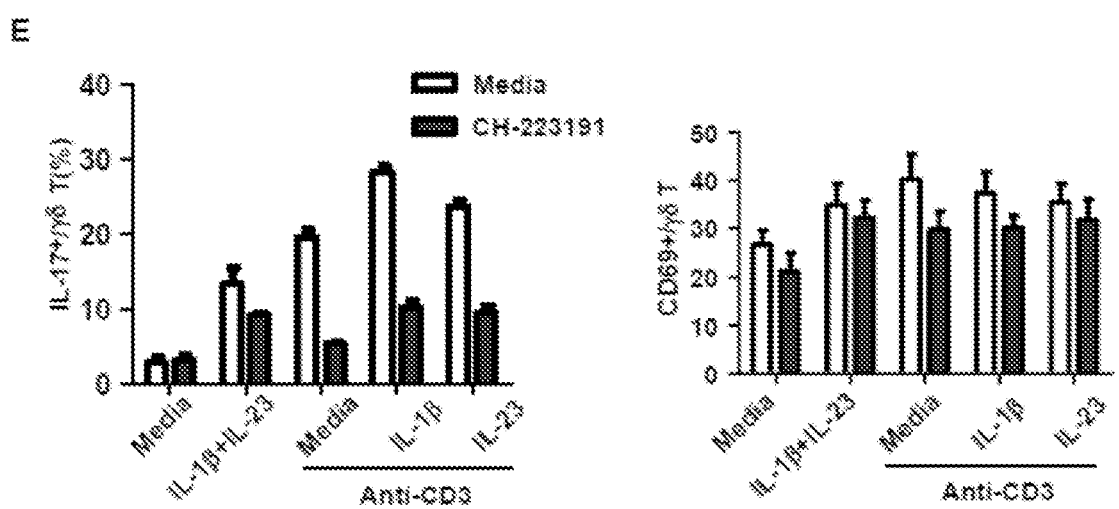

FIG. 6. A DC/γδT cell cross-talk leading to IL-1,3-dependent IL-17 production.

(A-B) Cocultures of naïve LNs derived γδ T (A-B) or TCR δT (A) cells in the presence of recombinant mouse cytokines (1 μg/ml IL-1β or/and IL-23, 5 μg/ml TGF-β, 10 μg/ml IL-6) (A) with or without TCR cross-linking with anti-CD3ε mAb pre-coated plates (5 μg/ml, Clone 145-2C11) (B).

(C) Triple or double mixed coculture of LNs derived γδ T cells and/or bone marrow-derived DC loaded or not with live or DX-treated MCA205 was monitored for IL-1β and IL-17A release with ELISA test at 48 hrs.

(D) DX-treated MCA205 loaded DC/γδ T cell cross-talk was also performed in the presence of 20 μg/ml IL-1RA (Amgen) or anti-IL-23 or IL-23R neutralizing antibodies or 10 μg/ml IL-18BP or 20 μM CH-223191. IL-1β and IL-17A release was measured at 48 hrs in ELISA.

(E) Naïve lymph node cells from C57bl/6 mice were seeded in 96 well plates, stimulated with cytokines indicated with or without anti-CD3 crosslinking in the presence of GolgiStop (BD Bioscience). IL-17 production and CD69 expression with or without CH-223191 are depicted. Graphs depict means±SEM of triplicate wells of cytokine release assessed at 48 hrs in ELISA. A representative experiment out of 3-6 is depicted in each case. *p<0.05.

Figure 7:
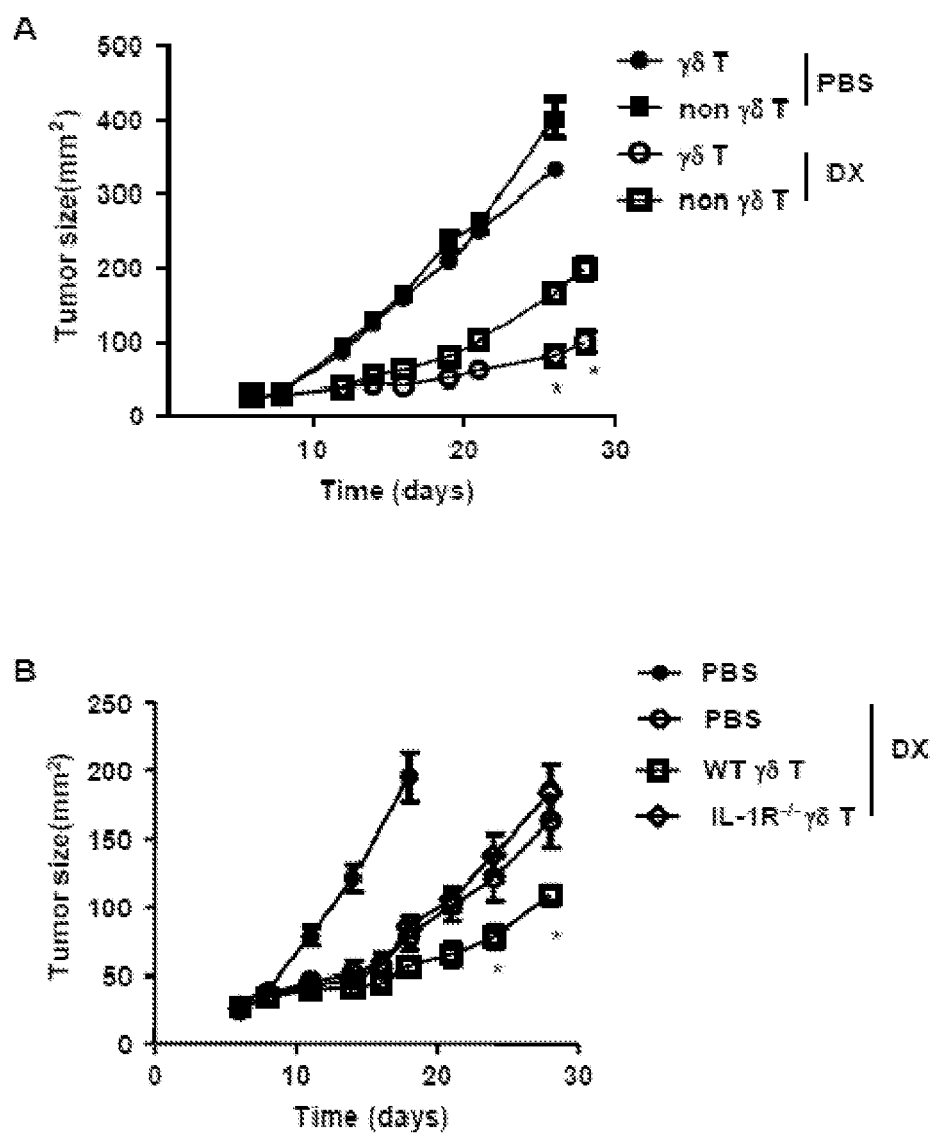

FIG. 7. Adoptive transfer of γδ T cells synergize with chemotherapy under condition that γδ T cells express IL-1R1.

(A) Tumor growth after an adoptive transfer of LN derived γδ T or TCRγ$^-$ T cells into tumor beds two days after local DX treatment in established MCA205 sarcoma.

(B) The synergistic effects between γδT cells and DX were analyzed comparing WT versus IL-1R1$^{-/-}$ γδ T cells. Tumor sizes is plotted as means±SEM for 5 mice/group. A representative experiment out of two yielding identical results is shown. *p<0.05.

Figure 8:
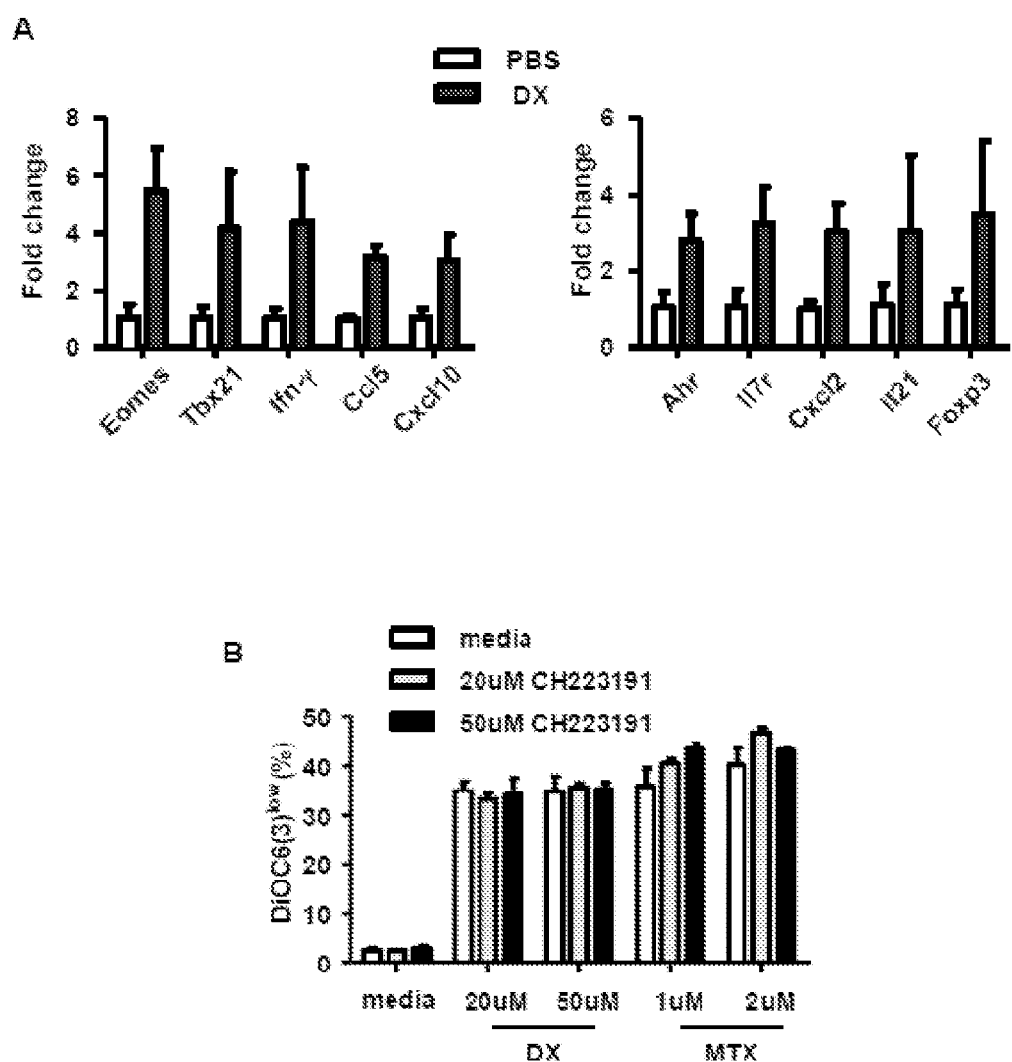

FIG. 8. DX polarizes TILs towards a TH1 and TH17 pattern.

(A) The precise calculation of fold changes for individual cytokine or chemokine, which was significantly increased at day 8 post-DX, is depicted for Th1– and Th17-like profiles as tested by low density array.

(B) The impact of AHR pharmacological inhibitor CH-223191 on pro-apoptotic effect of DX or MTX against MCA205 was measured. A reduction in mitochondrial membrane potential indicated by decreased DiOC6(3) fluorescence was used to show cell apoptosis. The experiment was performed twice with identical results.

Figure 9:
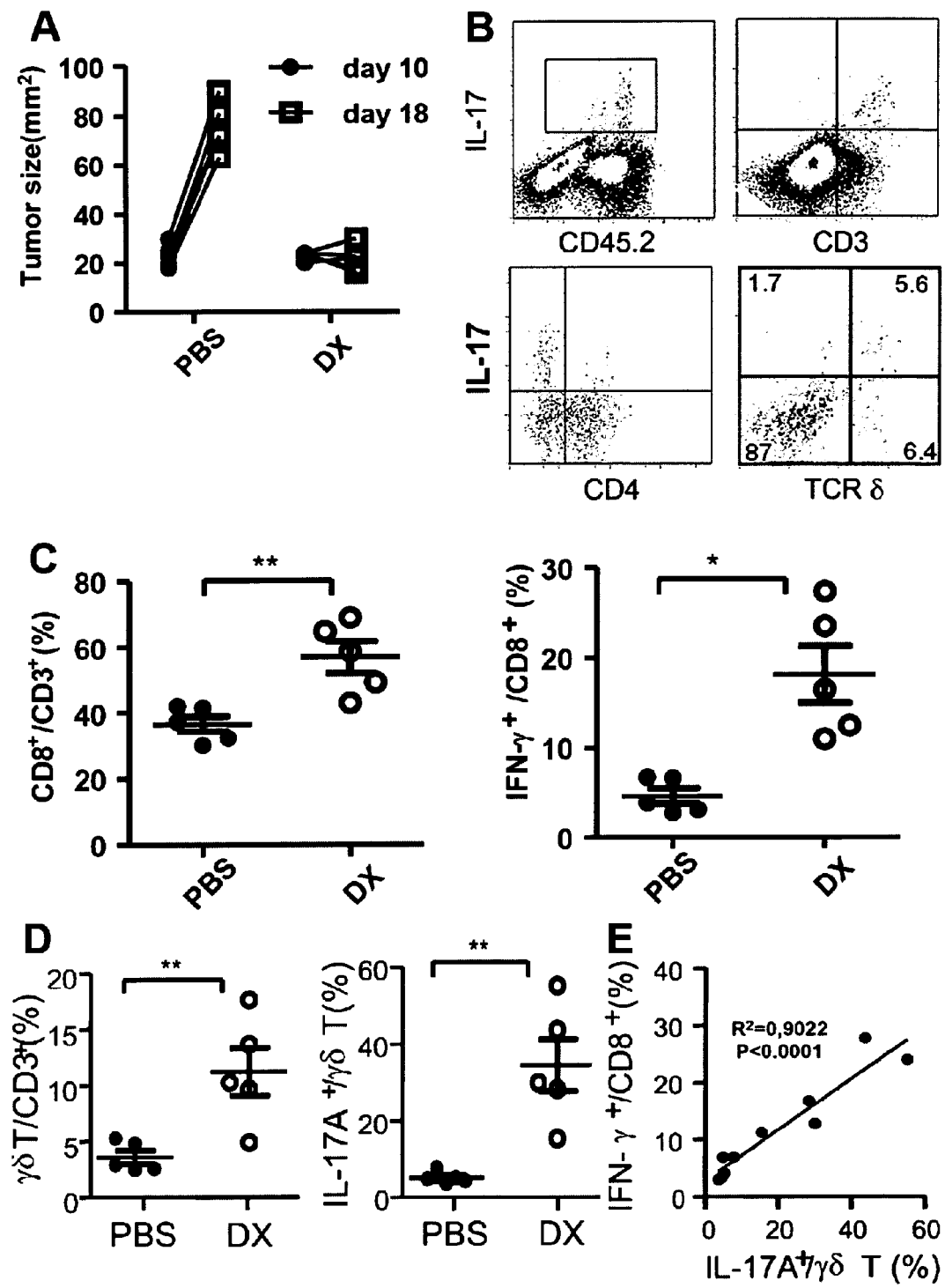

FIG. 9. Infiltration of CT26 tumors with Tc1 and γδ T17 cells after therapy with anthracyclines.

(A) Tumor growth kinetics after treatment of established CT26 colon cancers with PBS or DX. The graph depicts means±SEM of size in 5 tumors per condition.

(B) Single cell suspensions of CT26 tumors were analyzed by flow cytometry at day 8 post-DX. After gated on live cells, IL-17 production was checked in CD45.2$^+$, CD3$^+$, CD4$^+$, TCR δ$^+$ cells compared with their corresponding negative fractions. A typical dot plot is shown.

(C-D) The percentage of CD8 T cells among TILs and their IFN-γ production (C) and the percentage of γδ T cells among TILs and their IL-17 production (D) were examined in PBS versus DX-treated tumors by flow cytometry. Means±SEM of percentages in 5 tumors/group are indicated.

(E) Correlation between the percentages of γδ T17 and Tc1 TILs in all CT26 tumors (treated or not) was plotted (each dot representing one tumor).

*p<0.05, p<0.01, *p<0.001.

Figure 10:
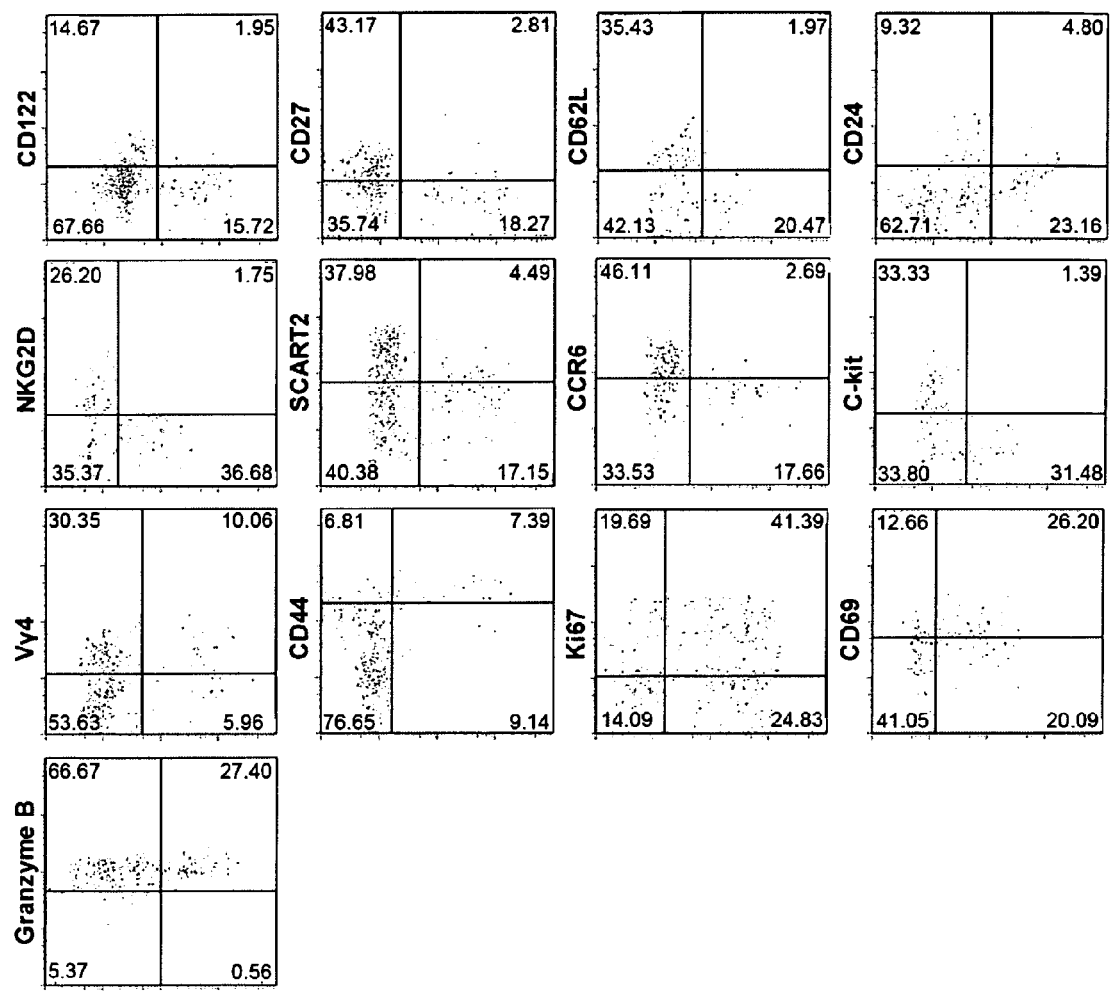

FIG. 10. Phenotype of tumor infiltrated γδ T cells after DX therapy.

Flow cytometry analyses of the γδ T17 cells in the gate of live CD45.2$^+$, CD3$^+$ T cells invading MCA205 tumors at day 8 post-DX after a staining using the antibodies indicated in the Y axis. A typical dot plot analysis is depicted. The experiment has been performed three times yielding identical results.

Figure 11:
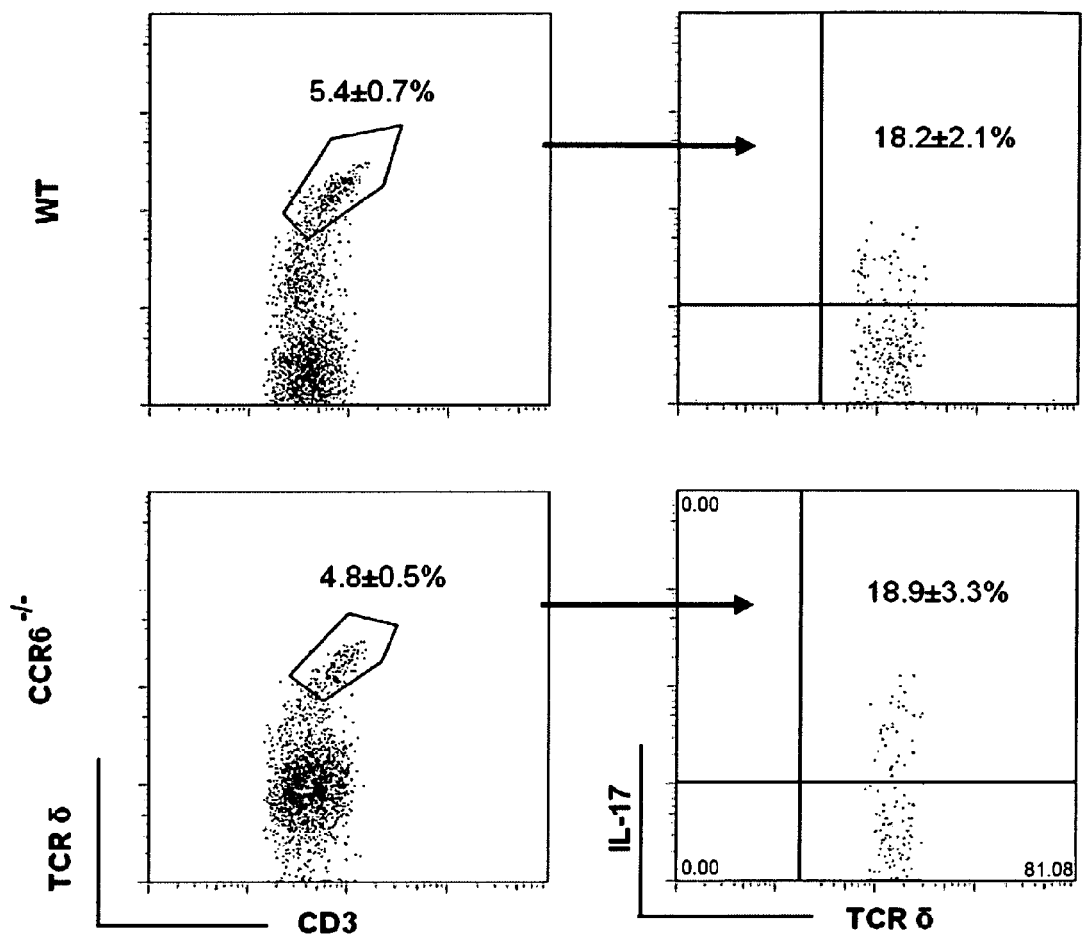

FIG. 11. CCR6 does not contribute to the recruitment of γδ T17 in tumors.

Flow cytometry analyses of the γδ T17 cells in the gate of live, CD45.2$^+$, CD3$^+$ T cells invading MCA205 tumors at day 8 post-DX in WT (upper panel) versus CCR6 loss-of-function mice (lower panel).

A typical dot plot analysis is depicted with means±SEM for 5 mice.

Figure 12:
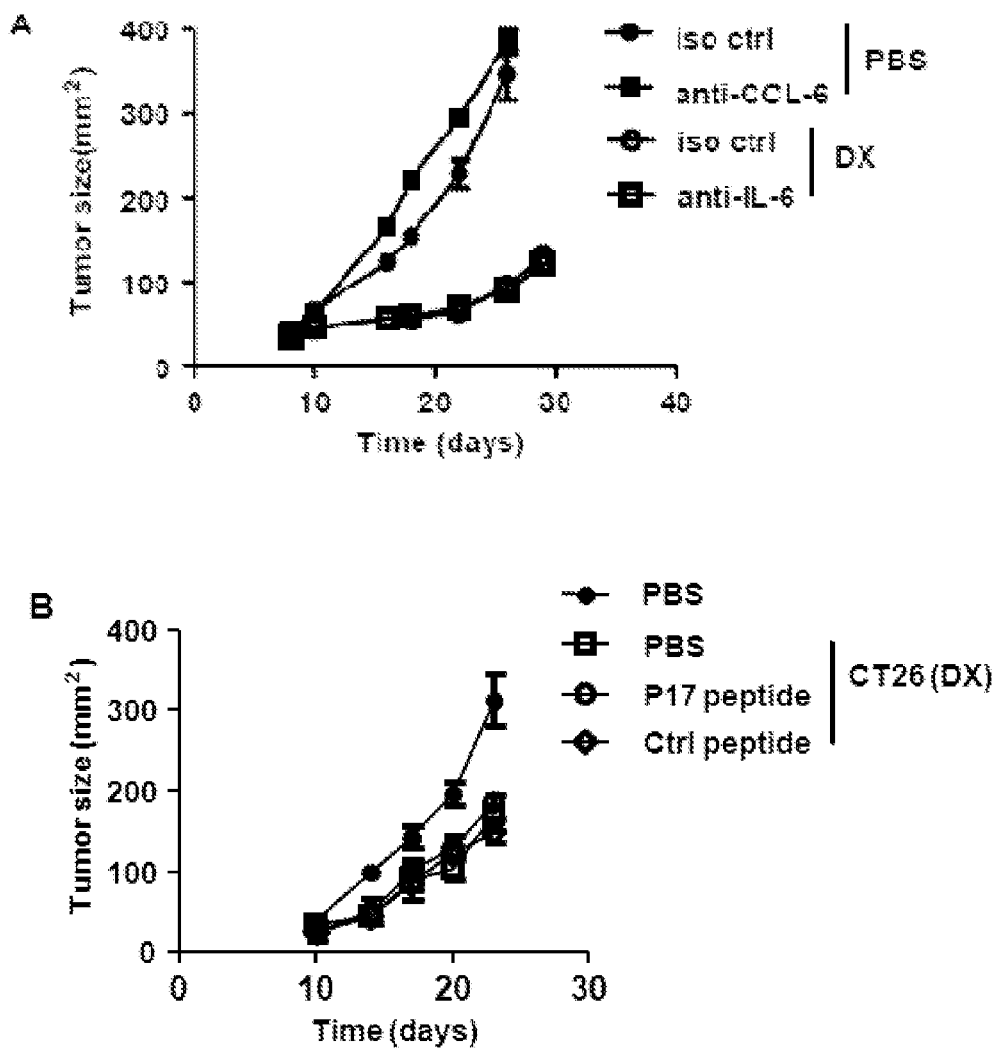

FIG. 12. IL-6 and TGF-β failed to play a role in the immunogenicity or therapeutic effects of anthracyclines.

(A) Established CT26 colon cancer was treated with doxorubicin (DX) in the presence of systemic administration of neutralizing anti-IL-6 Antibody (or isotype Control Antibody). Kinetic tumor growth with 5 animals/group was shown.

(B). Mice were immunized with DX treated CT26 on the right flank and concomitantly challenged with live CT26 tumor cells on the opposite flank at day 0. In parallel, anti-TGF-β or a control peptide (100 µg/mouse) were administered systemically from day 0 to 10. Kinetic tumor growth with 5 mice/group is shown for one representative experiment. The experiment has been performed twice yielding identical results. *p<0.05, p<0.01, *p<0.001.

Figure 13:
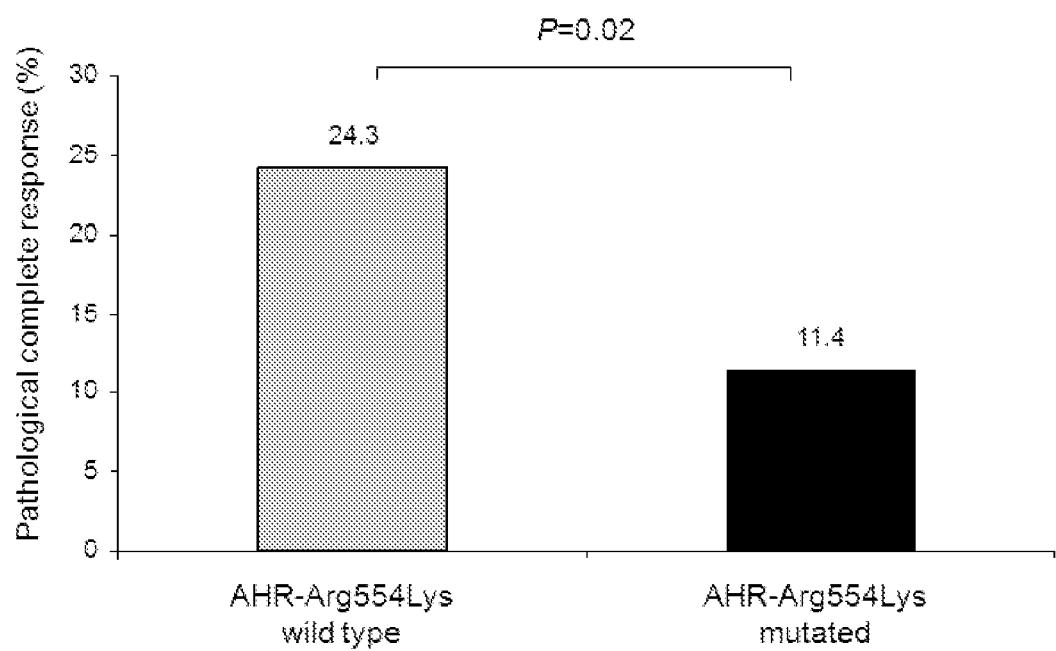

FIG. 13. The single-nucleotide polymorphism (SNP) R554K or Arg554Lys (rs2066853) in AHR gene affects the efficacy of conventional anti-cancer therapy in a neoadjuvant setting (before surgery) in breast cancer patients treated with anthracyclines (n=239).

The proportion of pathological complete responses was compared in wild-type and mutated groups of patients. The Chi square test was used to test the genetic association between the primary endpoint and the AHR-R554Ks SNP.

Figure 14:
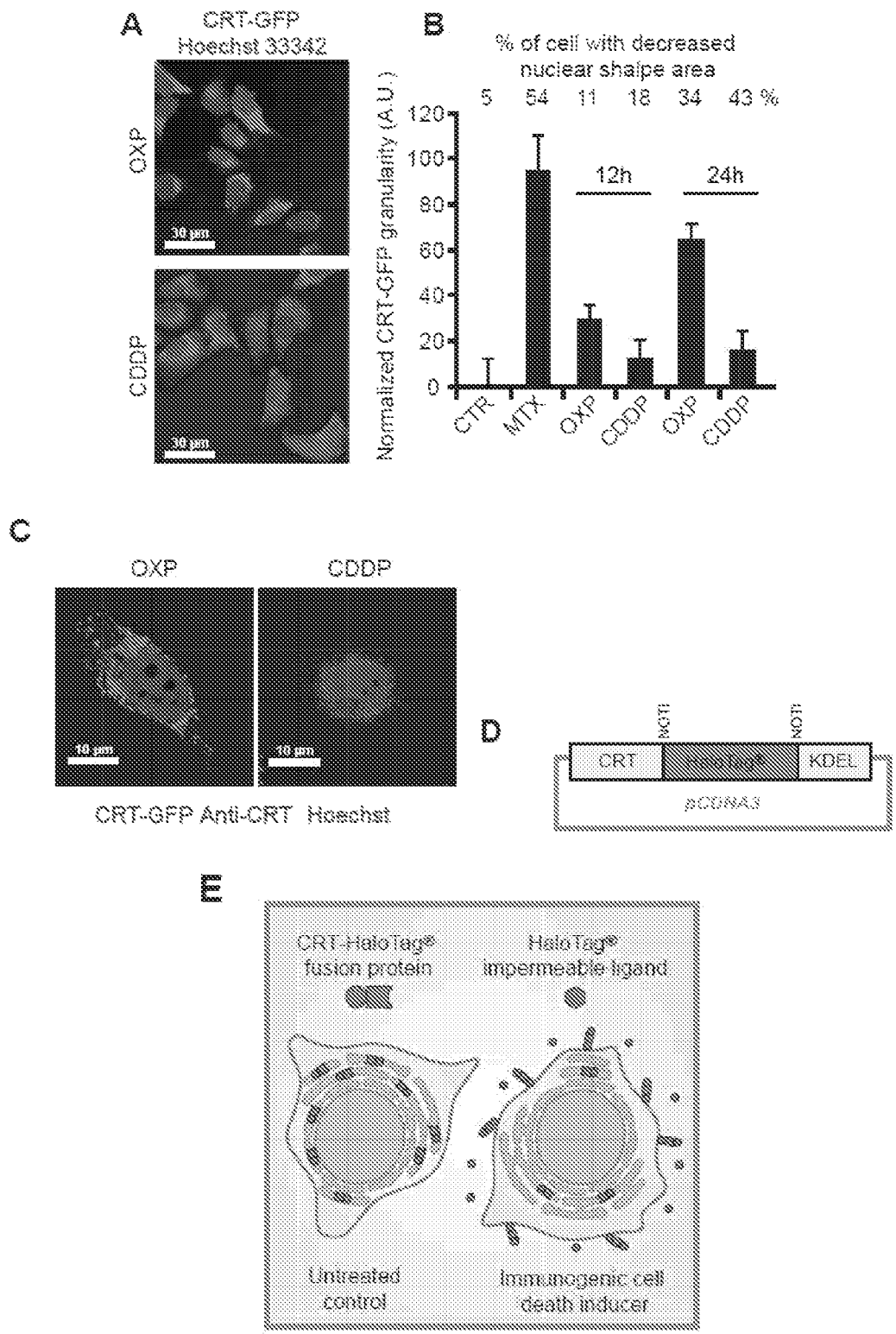

FIG. 14. Oxaliplatin induced CRT exposure.

U2OS cells stably expressing CRT-GFP treated with 1 µM mitoxantrone (MTX) 150 µM cisplatin (CDDP) or 300 µM oxaliplatin (OXP) for the indicated time have been analyzed by means of automated image acquisition and automated analysis. Data is depicted as (A) representative images (B) and normalized CRT-GFP granularity values as well as percent of cells exhibiting nuclear shrinkage. The data is depicted as mean±s.e.m. of quadruplicates from a representative experiment. (C) Immunofluorescene was conducted on CRT-GFP expressing cells by means of staining with anti-CRT antibody and subsequent confocal image acquisition. (D) CRT has been cloned in frame n-terminal to a HaloTag® sequence followed by a KDEL ER retention signal. (E) The impermeable HaloTag® ligand forms covalent bonds exclusively with surface exposed HaloTag®-CRT fusion protein, whereas intracellular HaloTag®-CRT remains undetected.

Figure 15:
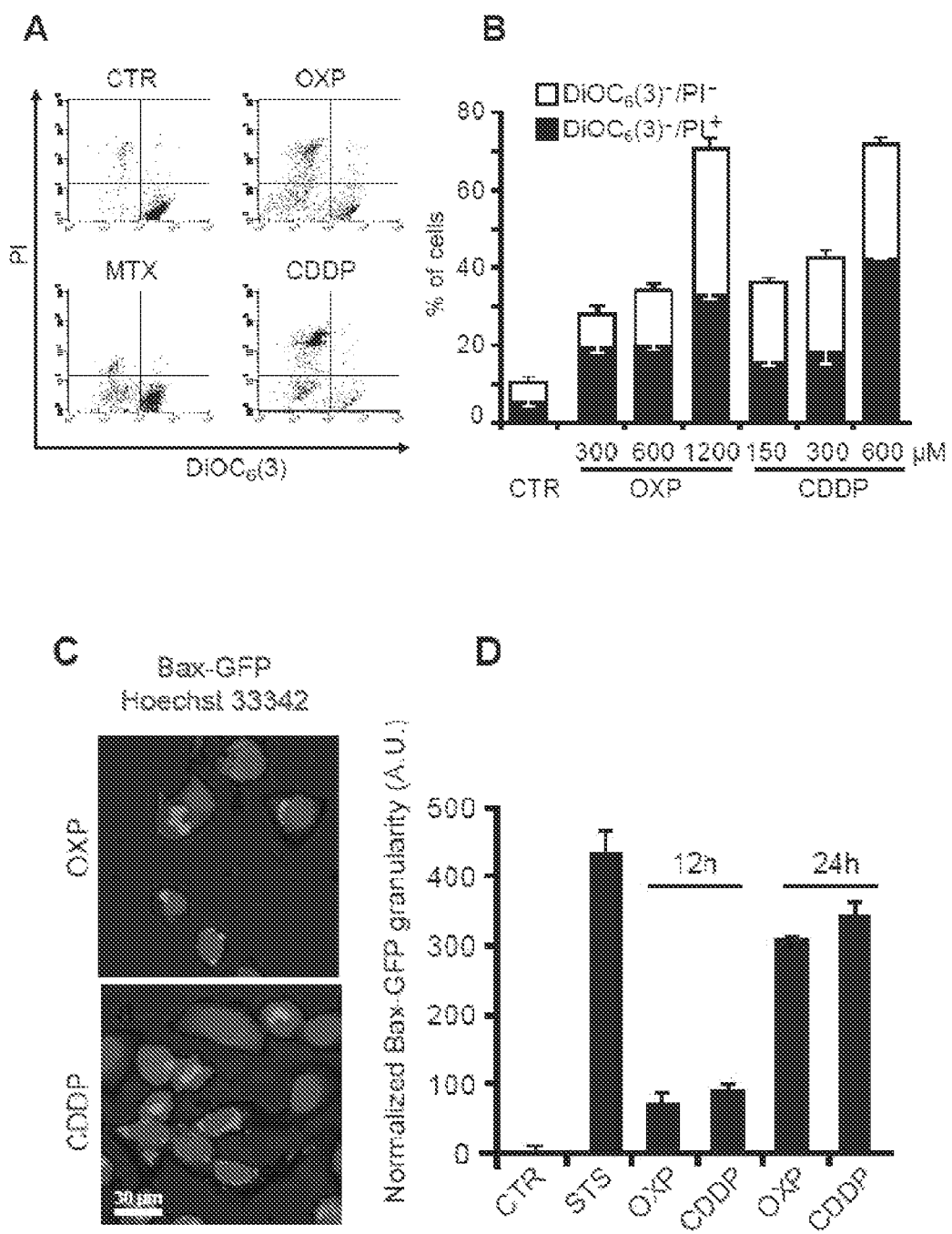

FIG. 15. Mitochondrial cell death upon treatment with oxaliplatin and cisplatin. U2OS cells stably expressing CRT-GFP treated with 1 µM mitoxantrone (MTX) 150 µM cisplatin (CDDP) or 300 µM oxaliplatin (OXP) have been acquired by means of an automated microscope and subsequently subjected to automated analysis. The data is depicted as representative images (A) and (B) normalized Bax-GFP granularity values.

The data represents mean±s.e.m. of quadruplicates from a representative experiment.

(C, D) U2OS cells were treated with the indicated drugs at the indicated concentrations.

16 h after treatment, cell death was monitored by simultaneous staining with 3,3 dihexyloxacarbocyanine iodide ($DiOC_6(3)$) and propidium iodide (PI), and the percentage of dying ($DiOC_6(3)^{low}$ PI−, open bars) and dead ($DiOC_6(3)^{low}$ PI+, closed bars) cells was determined by cytofluorometry.

The data represents means±s.e.m. of triplicate determinations.

Figure 16:
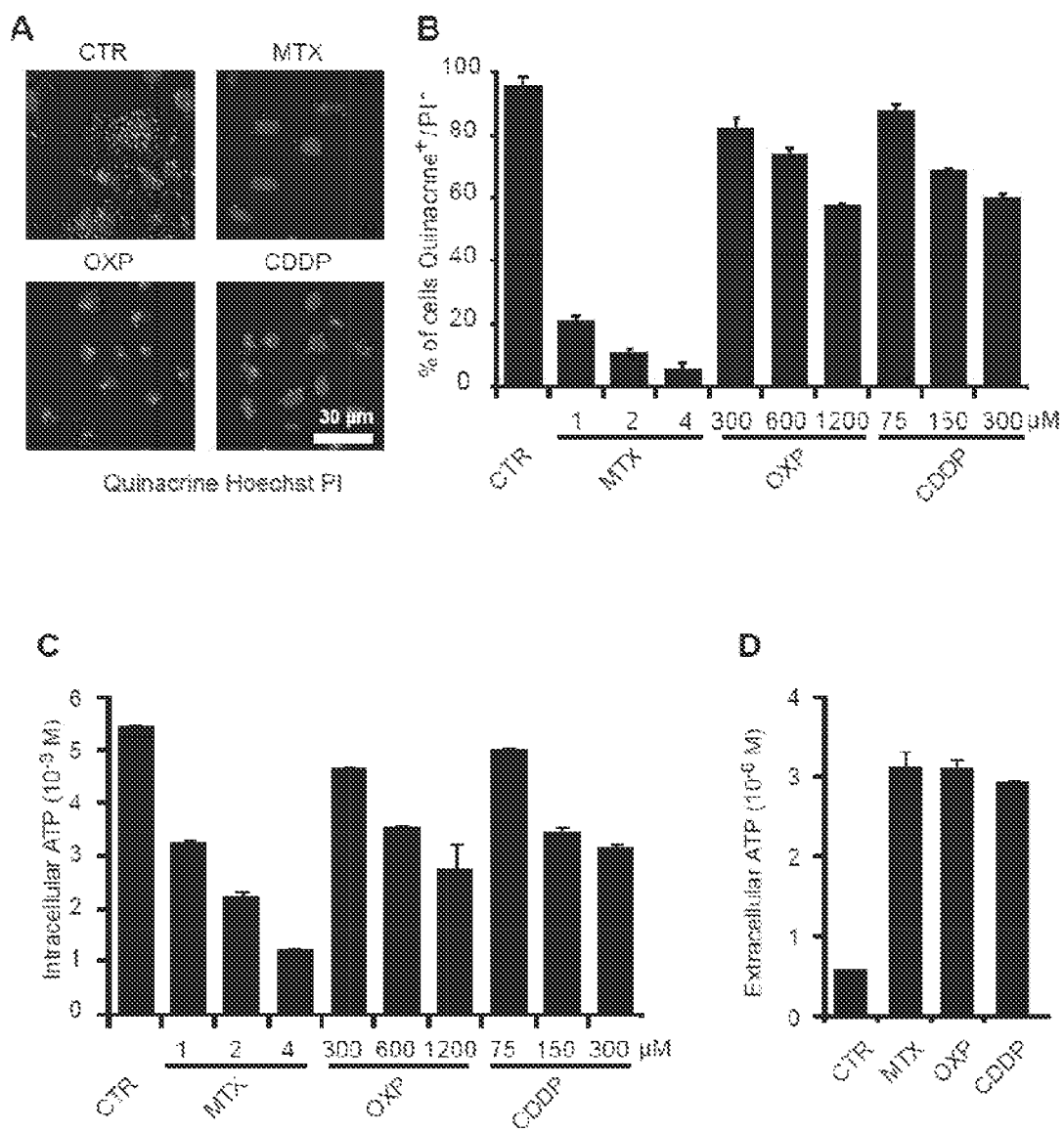

FIG. 16. Oxaliplatin and cisplatin induced ATP release.

Cells were treated with mitoxantrone (MTX), oxaliplatin (OXP), or cisplatin (CDDP) at the indicated concentrations. 16 h post-treatment, the intracellular ATP was stained with quinacrine and the nuclei were counterstained with Hoechst 33342. The vital dye propidium iodide (PI) was used to visualize dead cells before acquisition by (A) automated fluorescence microscopy or (B) cytofluorometric analysis. In addition, the concentrations of intracellular (C) and extracellular (D) of ATP were monitored.

Results are means±SEM of triplicate determinations.

Figure 17:
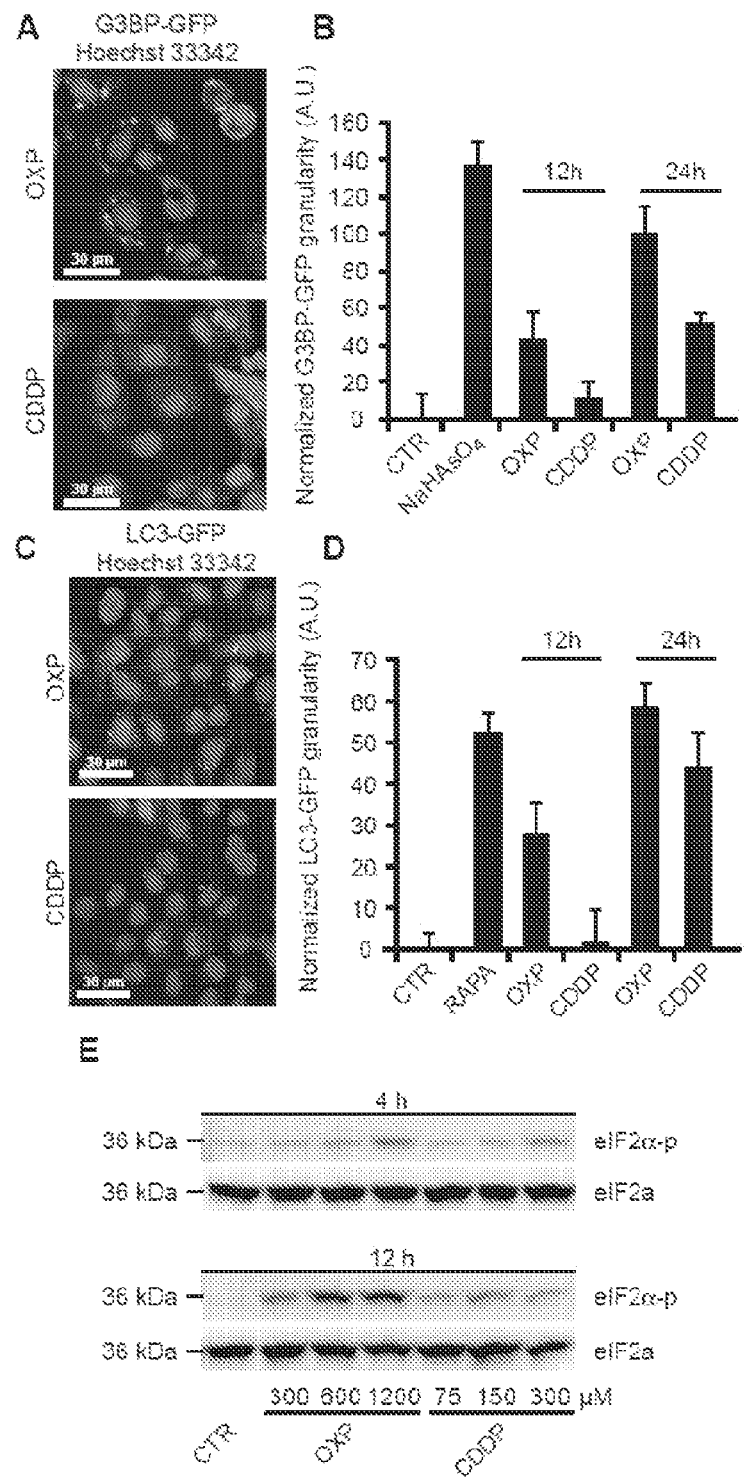

FIG. 17. OXP-, but not CDDP-induced ER stress markers.

Cells stably expressing G3BP-GFP or GFP-LC3 were treated for 4 h with 1 mM sodium arsenate heptahydrate ($NaHAsO_4$) or 10 µM rapamycin for 8 h as positive controls respectively. In addition the cells have been treated with 150 µM cisplatin (CDDP) or 300 µM oxaliplatin (OXP) for the indicated time to assess (A, B) the formation of stress granules and (C, D) the lipidation of LC3 as an indicator for autophagy. Representative images (A, C) and mean granularity values (B, D) of quadruplicates are shown.

(E) The phosphorylation status of eIF2α has been assessed by immunobloting against the phosphoneoepitope Ser51 of eIF2α by means of a monoclonal antibody. A polyclonal antibody has been used to visualize whole eIF2α protein levels.

Figure 18:
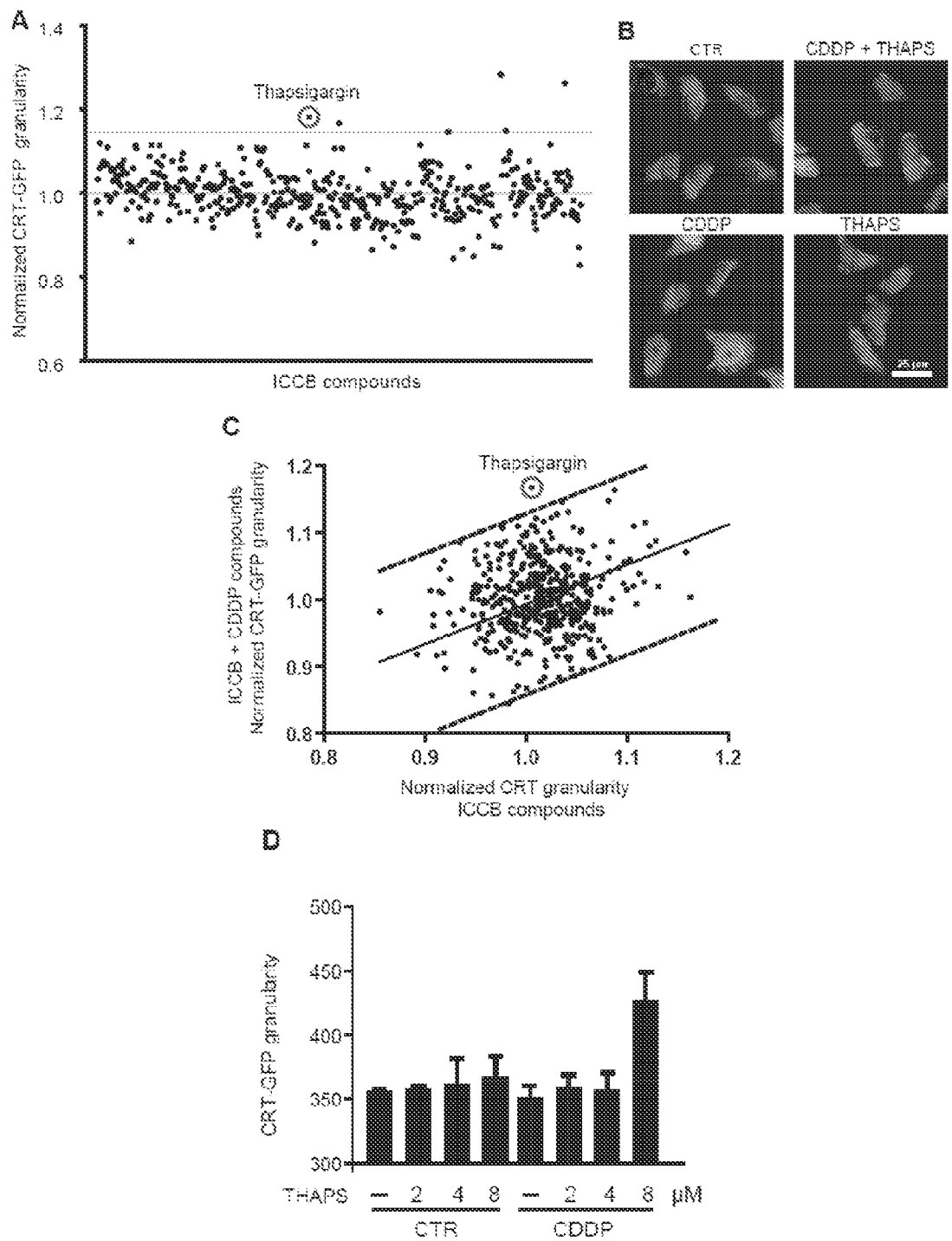

FIG. 18. Thapsigargin restores CRT exposure in the presence of cisplatin.

Compounds from the ICCB known bioactive compounds library have been tested for their capacity to induce CRT-exposure. The library compounds were added at a concentration range from 90 nM to 48 µM in the presence (A) or absence (C) of 50 µM cisplatin (CDDP). The cells were incubated for 4 h and were acquired by means of automated microscopy. The data is depicted as dot plots and representative images (B).

To eliminate background produced by other library compounds the data from the library screen in the presence of cisplatin was plotted against data from a screen in the absence of CDDP. Mean as well as 95% percentile is depicted and the data represents doublets from two independent experiments.

(D) CRT exposure has been measured 4 h upon application of the indicated dose range of thapsigargin (THAPS) with and without 50 µM CDDP. Samples have been acquired in quadruplicates from 3 independent experiments and data is depicted as mean±s.e.m.

Figure 19:
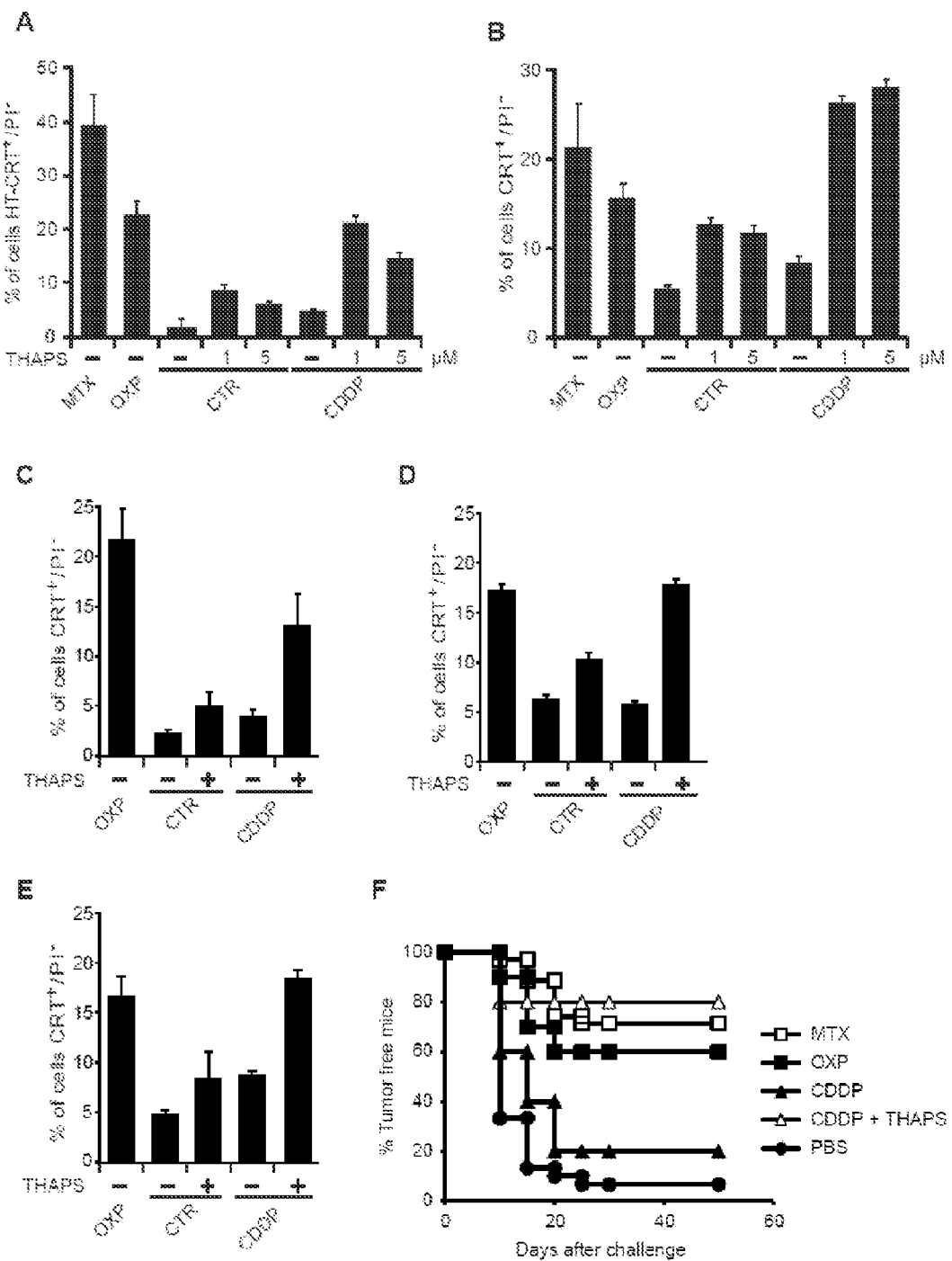

FIG. 19. Thapsigargin restores CRT-exposure of cisplatin treated cells in vitro and anti cancer immunogenicity in vivo.

(A, B) U2OS or HaloTag®-CRT stably expressing U2OS cells were assessed after a treatment with mitoxantrone (MTX), oxaliplatin (OXP), cisplatin (CDDP), thapsigargin (THAPS) or cisplatin combined with thapsigargin by immunofluorescence staining or incubation with impermeable fluorescent HaloTag® ligand respectively followed by flow cytometric analysis. CRT exposure upon combination of 150 µM CDDP with 1 µM THAPS was confirmed in (C) mouse lewis lung cell carcinoma, (D) CT26 and (E) MCA205 cells by means of immunostaining and following flow cytometric analysis.

(F) MCA205 cells have been used for tumor vaccination in vivo. Treated cells have been inoculated subcutaneously into the flank of C56BL/6 mice. The mice have been rechallenged after 6 days with living cells and the tumor growth is depicted in the survival plot (n=10).

Figure 20:
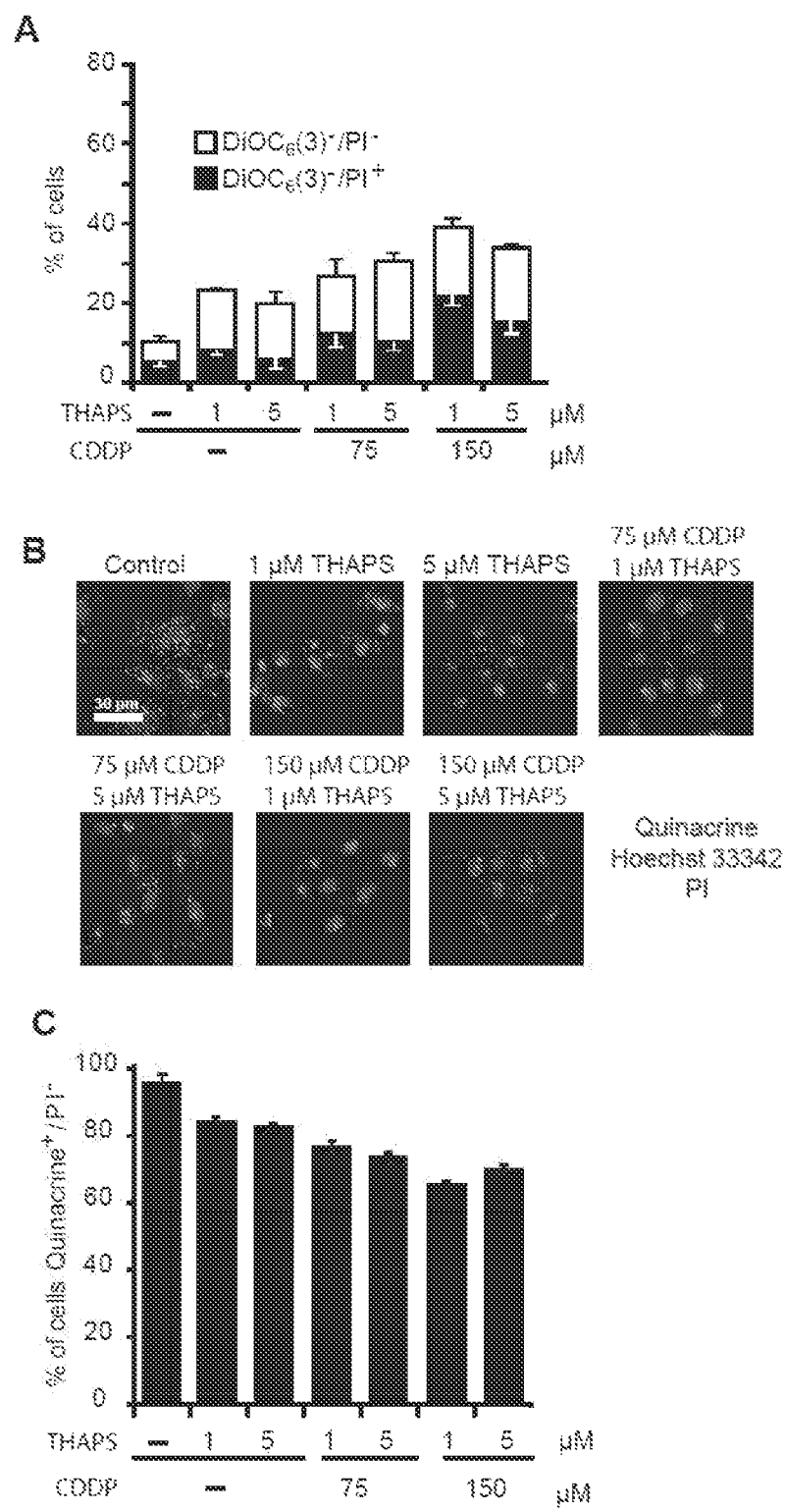
Figure 20:
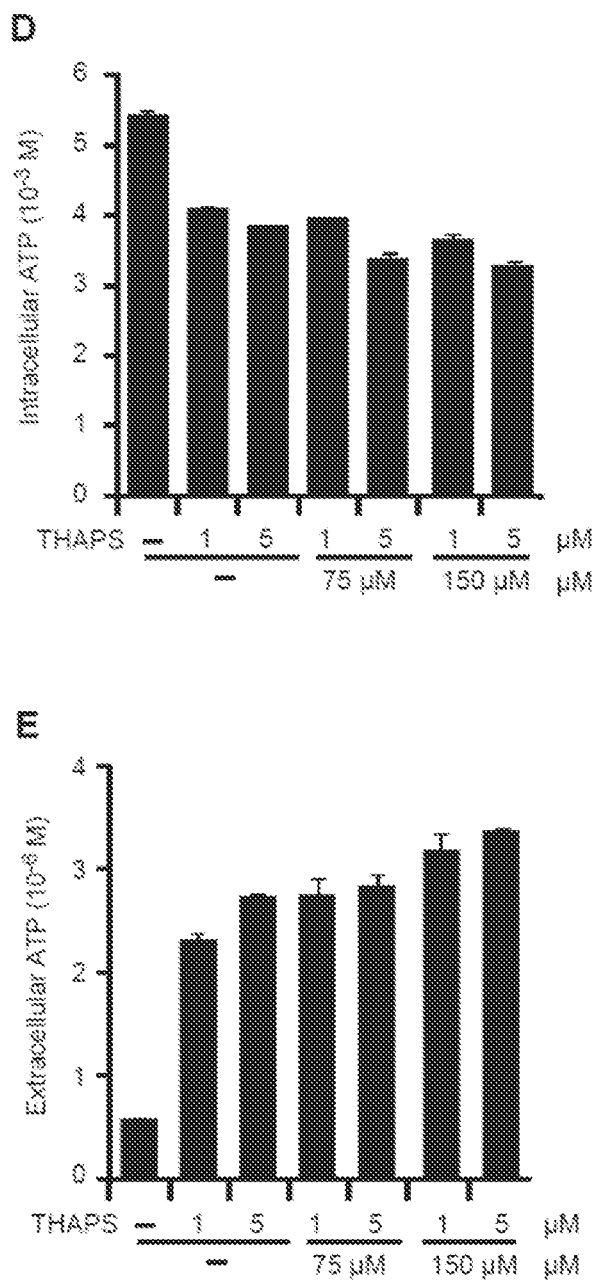

FIG. 20. THAPS exhibits no additional cytotoxicity.

(A) U2OS cells were treated with the indicated drugs in the presence or absence of thapsigargin (THAPS) at the indicated concentrations. 16 h after treatment, cell death was monitored by simultaneous staining with 3,3 dihexyloxacarbocyanine iodide ($DiOC_6(3)$) and propidium iodide low (PI), and the percentage of dying ($DiOC_6(3)^{low}$ PI−, open bars) and dead ($DiOC_6(3)^{low}$ PI+, closed bars) cells was determined by cytofluorometry.

The data represents means±s.e.m. of triplicate determinations.

(B, C) U2OS cells were treated with mitoxantrone (MTX), oxaliplatin (OXP), or cisplatin (CDDP) with and without THAPS at the indicated concentrations. 16 h post-treatment, the intracellular ATP was stained with quinacrine and the nuclei were counterstained with the Hoechst 33342. The vital dye propidium iodide (PI) was used to visualize dead cells before acquisition by (B) automated fluorescence microscopy or (C) cytofluorometric analysis.

In addition, the concentrations of intracellular (D) and extracellular (E) of ATP were monitored. Results are means±SEM of triplicate determinations.

Figure 21:
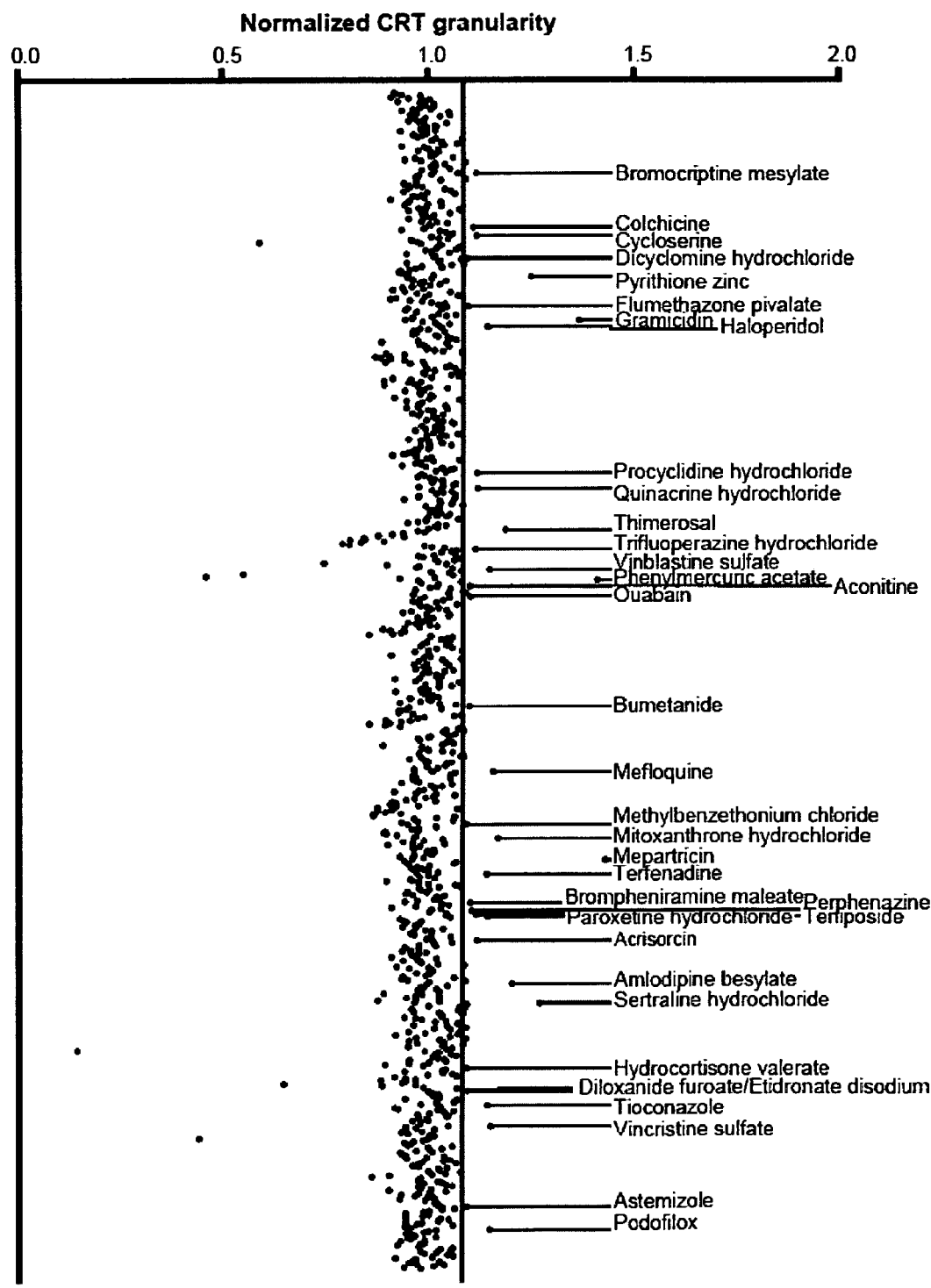

FIG. 21. "CRT screen"

Compounds from the US drug compound library have been tested for their capacity to induce CRT-exposure. The library compounds were tested at a final concentration of 1 µM in CRT-GFP, H2B-RFP stably expressing U2OS cells. The cells were incubated for 4 h and were acquired by means of automated microscopy. The data is depicted as dot plots representing normalized mean values (n=4).

Figure 22:
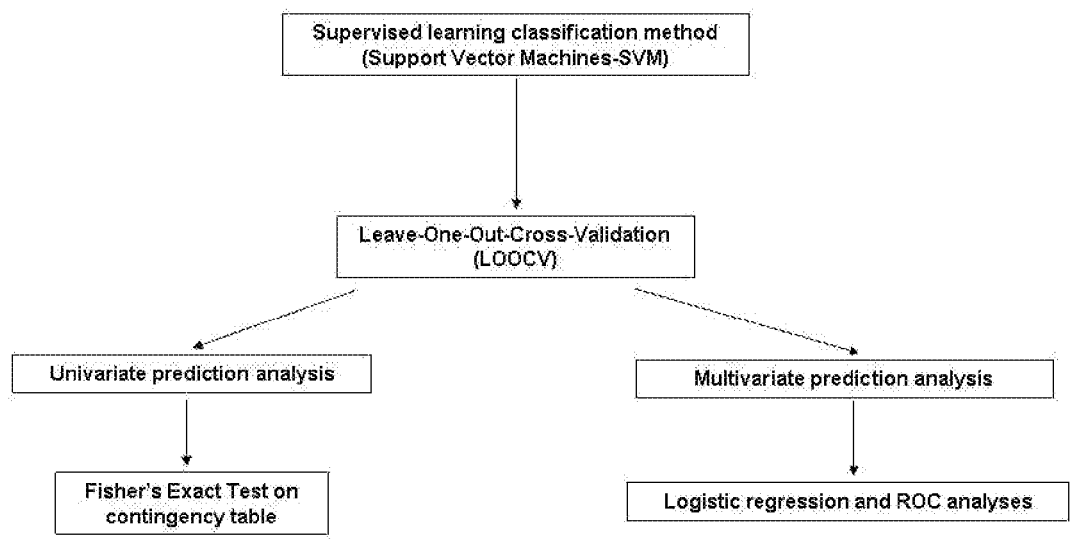

FIG. 22. Study profile

The Support Vector Machine (SVM) analyses were performed with the MEV software version 4.5. The LOOCV approach was used as SVM process to estimate the prediction accuracy of the molecular classifiers. The relevance of these classifiers was then tested with univariate (Fisher's exact test) and multivariate (logistic regression and ROC curves) methods.

Figure 23:
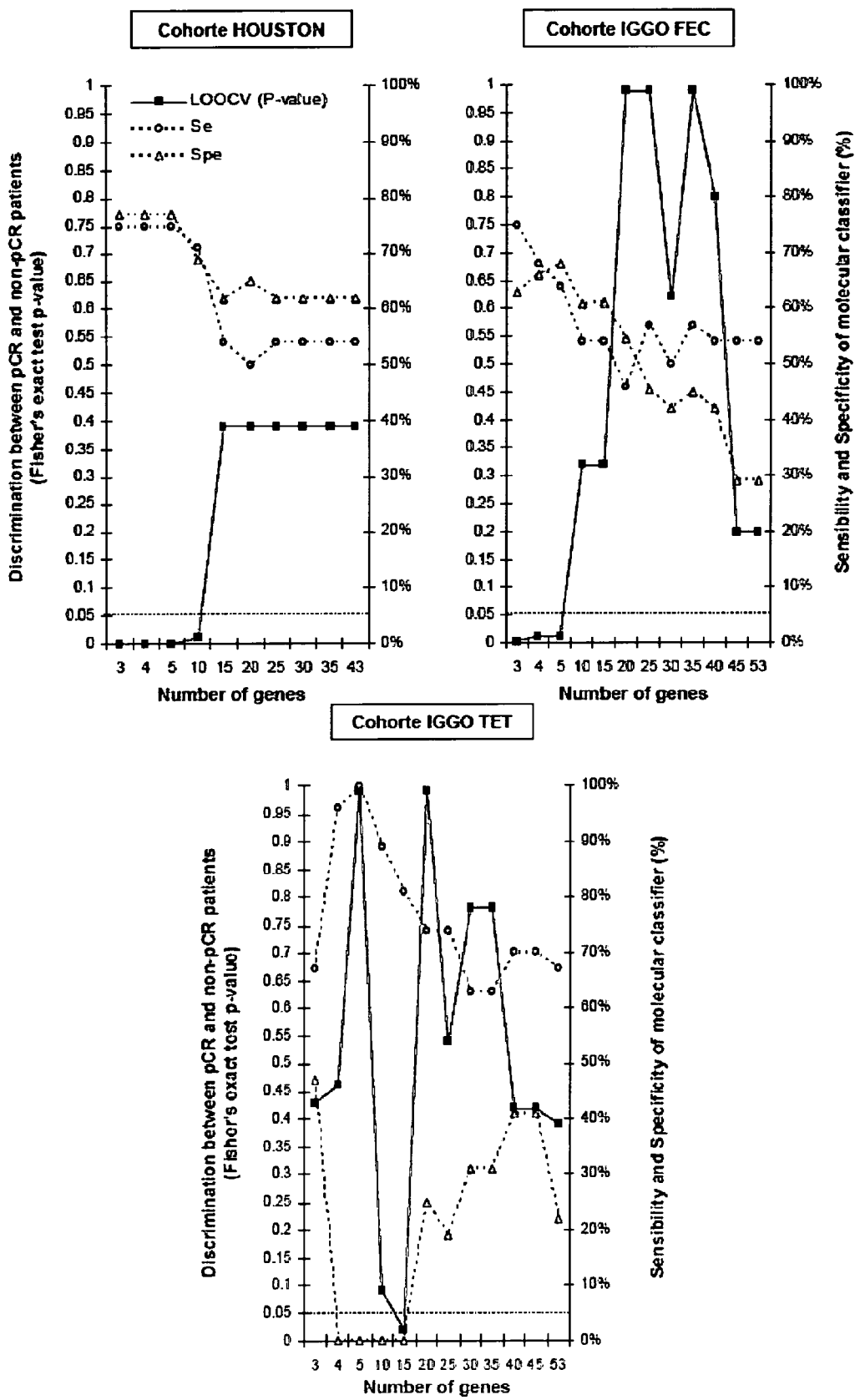

FIG. 23. "Calreticulin pathway" molecular classifiers based on 5 to 3 genes are detected in the two anthracycline treated cohorts (FEC) but not in the taxane treated cohort (TET).

The prediction accuracy of each molecular classifier was assessed by Fisher's exact test on the "pCR vs non pCR" contingency tables obtained from the LOOCV approach of SVM procedure. The SVM training parameters used were a polynomial kernal matrix with a diagonal factor of 1.3. The predictive value of the classifier was also evaluated by the sensibility (Se) and specificity (Spe) parameters. The "calreticulin pathway" was represented by an initial set of 43 genes in the cohort HOUSTON FEC and 53 genes in the cohort IGGO FEC/TET.

Figure 24:
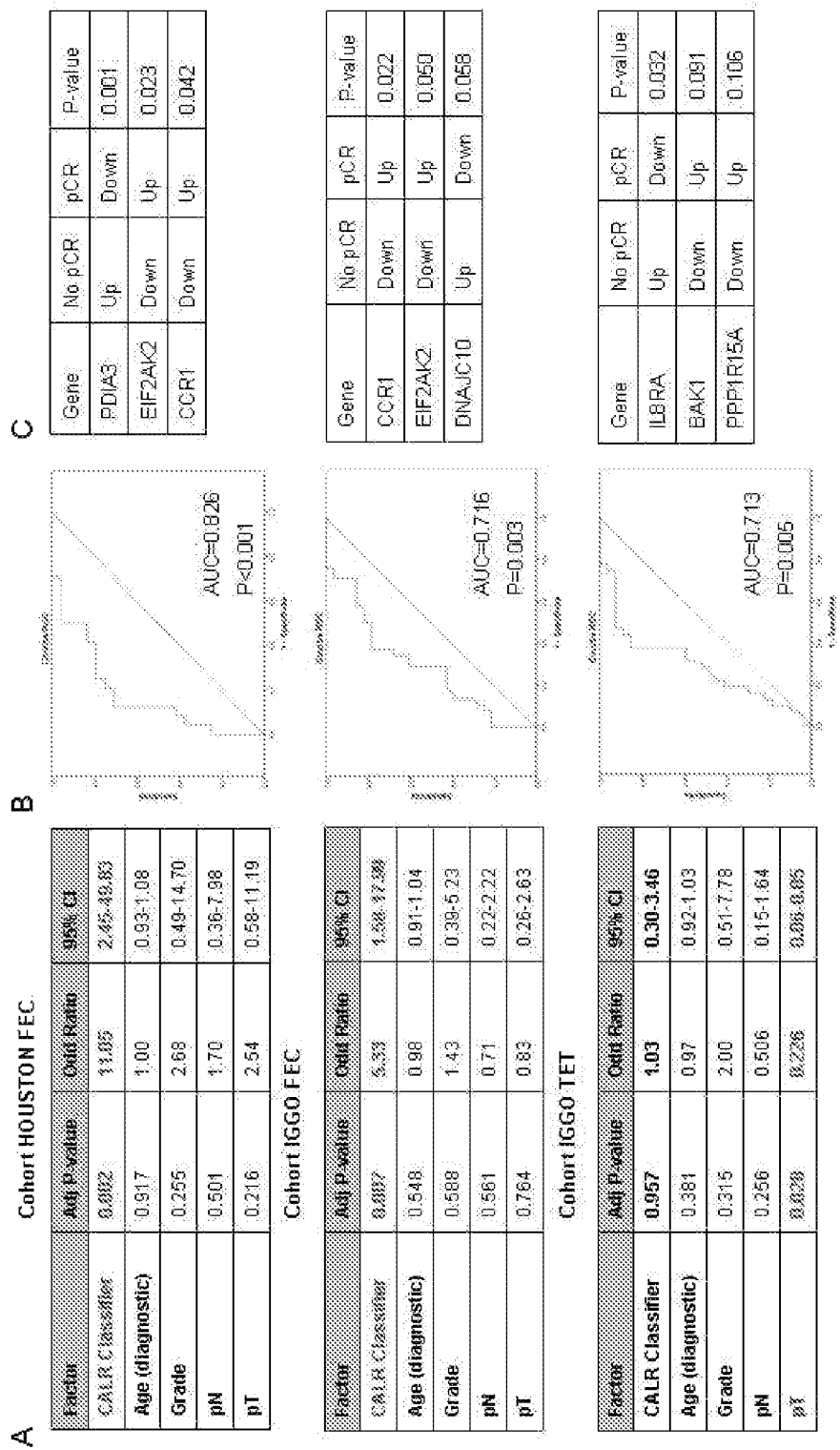

FIG. 24. Three genes based—"Calreticulin pathway" molecular classifiers are independent predictive factors in the two anthracyclines treated cohorts (FEC) but not in the taxane treated cohort (TET).

A. Multivariate analyses using logistic regression were performed in each cohort to test the association of the molecular classifier with a pathological complete response (pCR) by taking into account the effects of classical clinical factors. The HOUSTON FEC cohort was matched on oestrogen receptor status. The IGGO FEC and TET cohorts were restricted to patients with oestrogen-receptor-negative tumours.

B. ROC curves were used to test the quality of the predictions.

C. The under-expression (down) or over-expression (up) of genes in the classifiers between pCR and non pCR groups are mentioned with the respective p-values of non parametric Mann-Whitney test. Adj P-value: adjusted P-value; 95% CI: 95% confidence interval; AUC: area under ROC curve.

Figure 25:
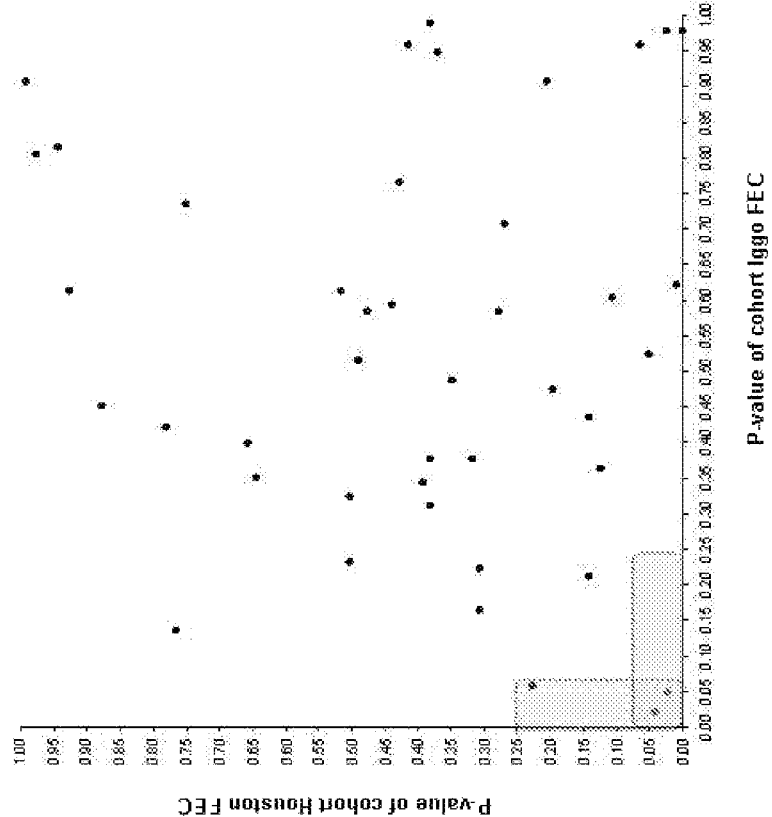

FIG. 25. Search of a common "Calreticulin pathway" molecular classifier between the two anthracyclines treated cohorts (FEC).

A. The genes were classified by decreasing value according to the non parametric Mann-Whitney test used to compare the gene expressions between pCR and non-pCR groups. * These genes are represented by median values of replicates.

B. The p-values of genes from anthracyline-treated cohorts (FEC) were plotted. The common molecular classifier was constructed with the candidate genes located in the grey areas.

Figure 26:
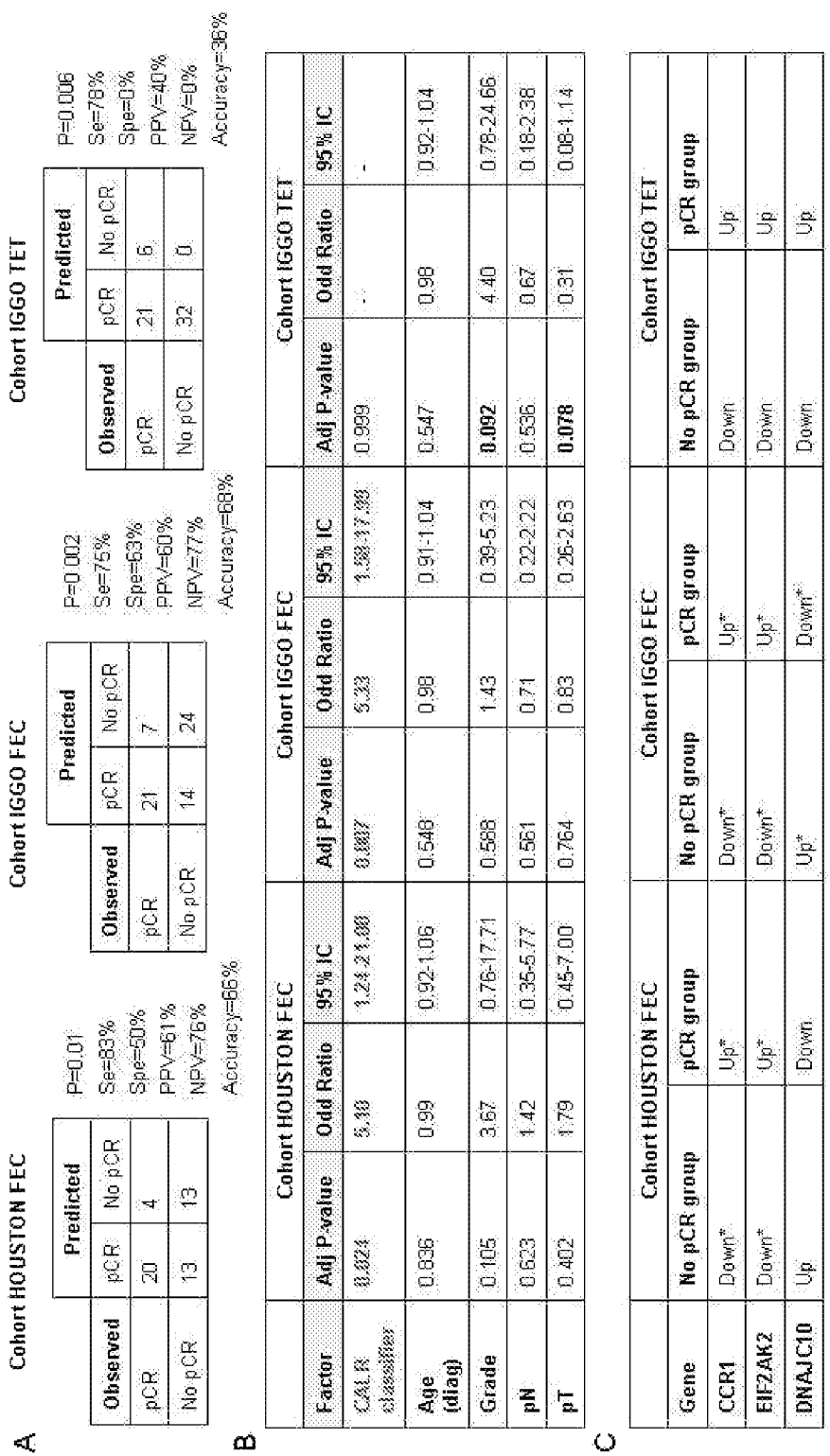

FIG. 26. The common 3 genes based "Calreticulin" molecular classifier is an independent predictive factor in the two anthracyclines treated cohorts (FEC) but not in the taxane treated cohort (TET).

A. The prediction accuracy of the common molecular classifier was assessed by Fisher's exact test on the "pCR vs non pCR" contingency tables obtained from the LOOCV approach of SVM procedure. The SVM training parameters used were a polynomial kernal matrix with a diagonal factor of 2. The predictive value of the classifier was also evaluated by the sensibility (Se), specificity (Spe), positive and negative predictive values (PPV and NPV) and accuracy parameters.

B. Multivariate analyses using logistic regression were performed in each cohort to test the association of the common molecular classifier with pathological complete response (pCR) by taking into account the effects of classical clinical factors.

C. The under-expression (down) or over-expression (up) of genes in the common classifier between pCR and non pCR groups are mentioned. * The gene expression differences were statistically significant between the pCR and non-pCR groups.

Figure 27:
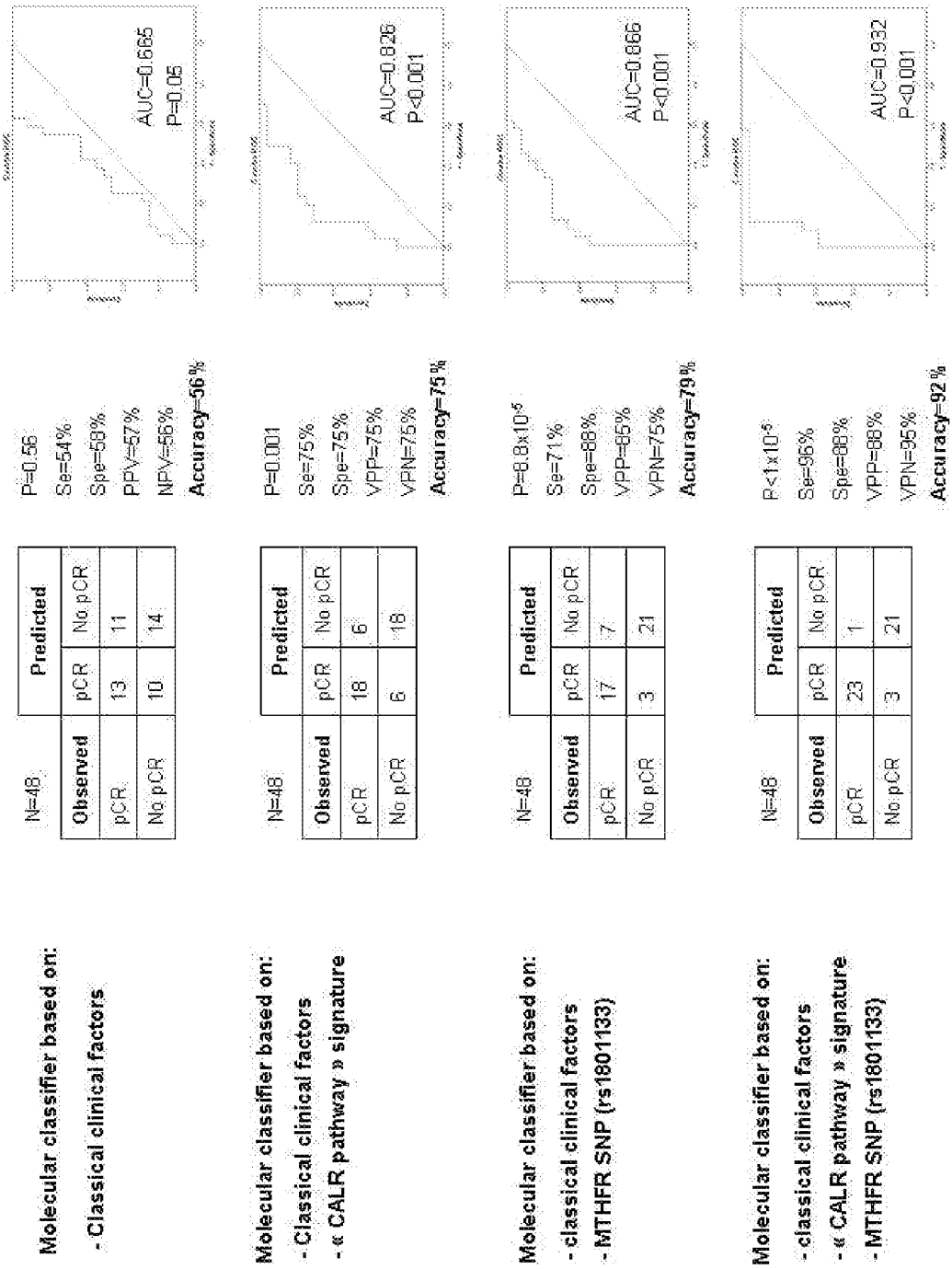

FIG. 27. A molecular parameter signature (also herein identified as "algorithm") that integrates the "CALR pathway" signature and a MTHFR SNP is particularly efficient to predict the ability of a given subject to respond to anthracyclines in the HOUSTON FEC cohort.

Multivariate analyses using logistic regression and ROC curves were performed to assess the prediction accuracy of four different models of classifiers.

Figure 28:
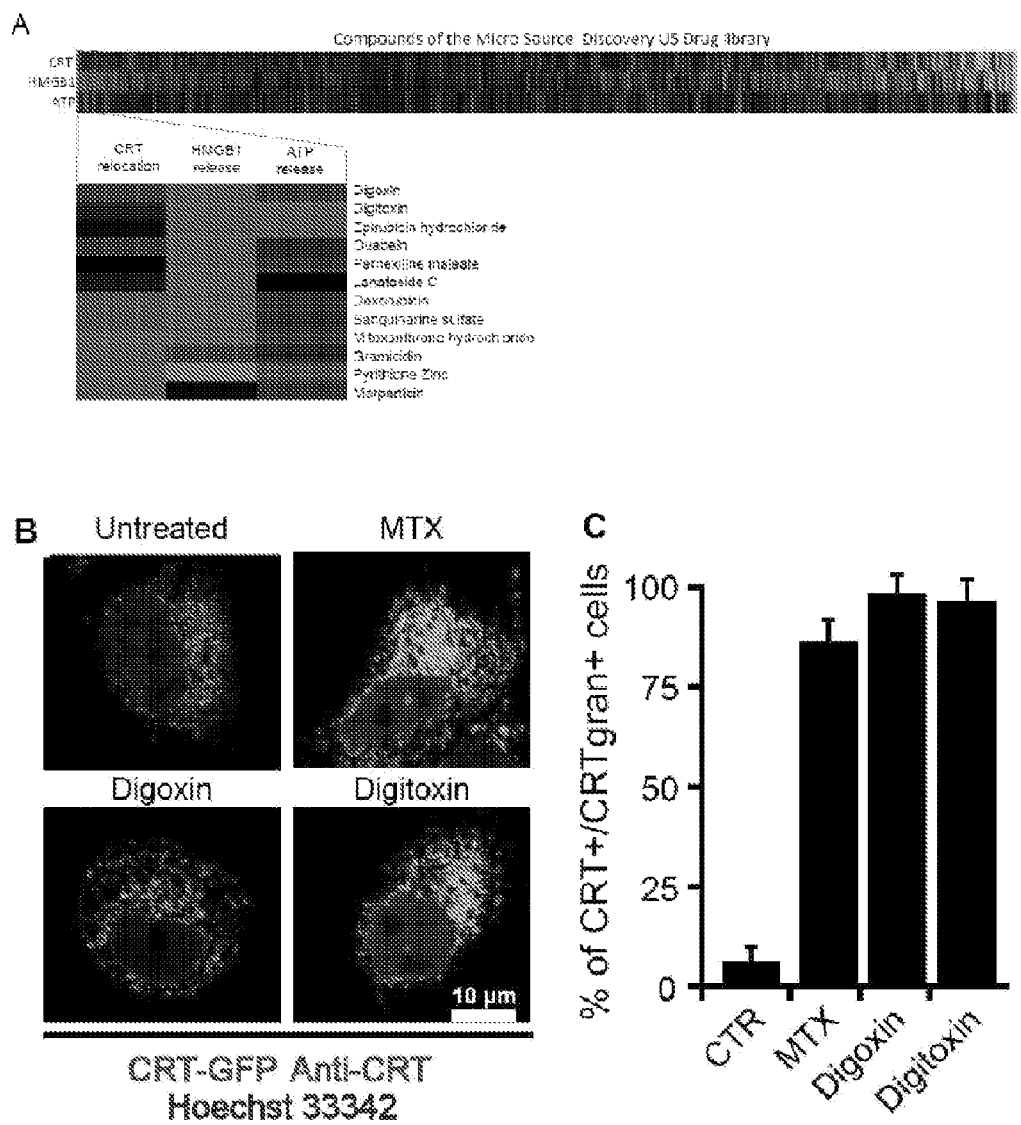
Figure 28:
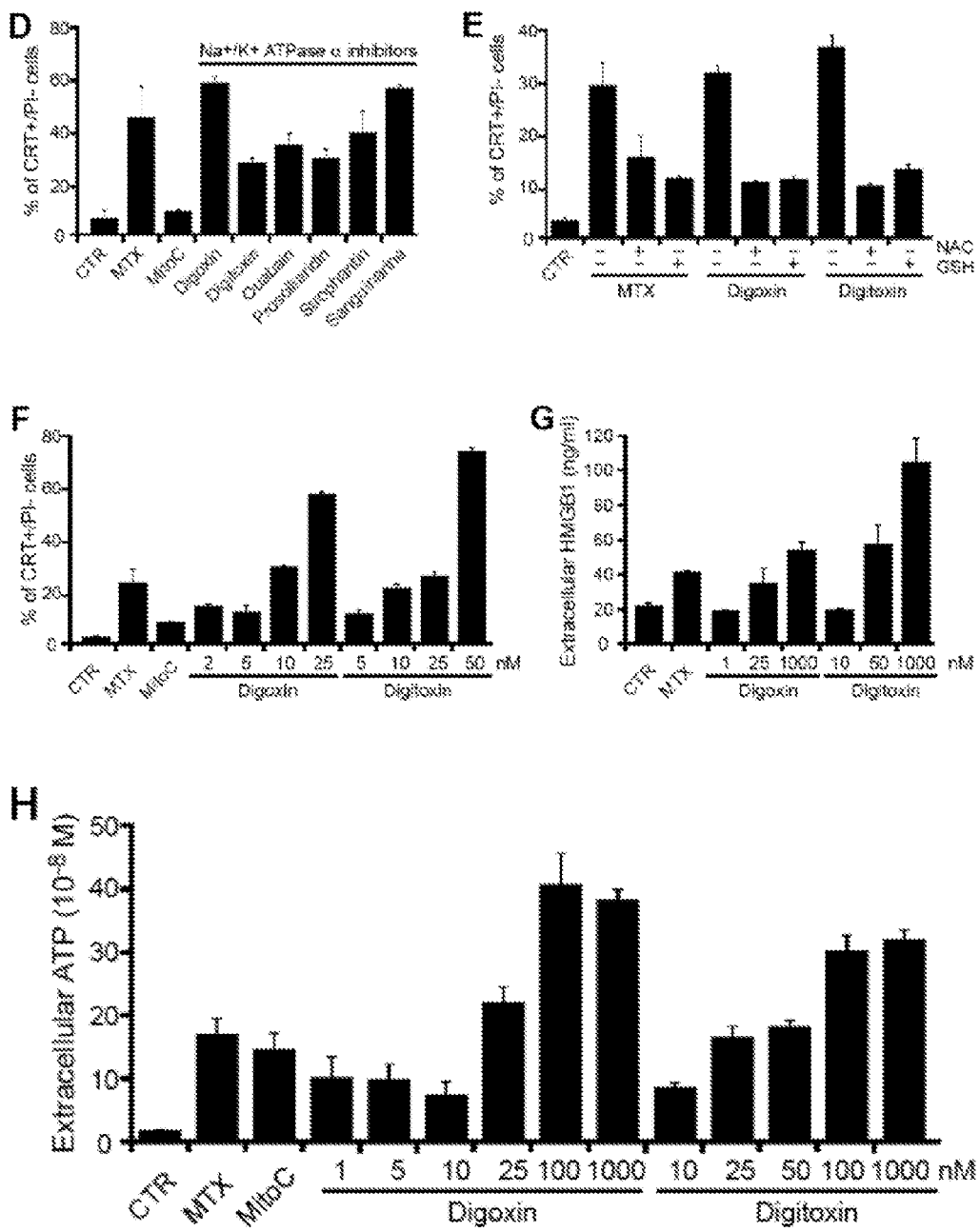

FIG. 28: Cardiac Glycosides emit immunogenic signals.

Compounds from the US Drug library have been tested for their capacity to induce CRT-exposure, HMGB1 release and ATP release.

(A) The library compounds were added at a concentration of 1 µM and U2OS cells were incubated for 4 h, 15 h or 24 h and CRT-GFP, HMGB1-GFP and quinacrine signal was acquired by means of automated microscopy respectively. The data is depicted as rank scored heat map (A).

(B,C) CRT exposure has been measured 4 h upon application of the indicated drugs using laser confocal line scanning microscopy. A minimum of 500 cells have been analysed per sample and data is depicted as mean±s.e.m.

(D) Cardiac glycosides at 1 µM have been analysed for CRT exposure by means of anti-CRT surface staining and FACS quantification.

(E) NAC and GSH pretreated U2OS cells were analyzed for CRT exposure by FACS and inhibition of reactive oxidative species abolished CRT exposure.

(F) U2OS cells treated with the indicated doses of Digoxin and Digitoxin were analyzed for CRT exposure by means of FACS quantified surface staining.

(G) HMGB1 release was measured using HMGB1 ELISA 24 h after treatment in the supernatants of cells.

(H) ATP release was quantified by ENLITE 15 h after treatment in the supernatant of cells.

Figure 29:
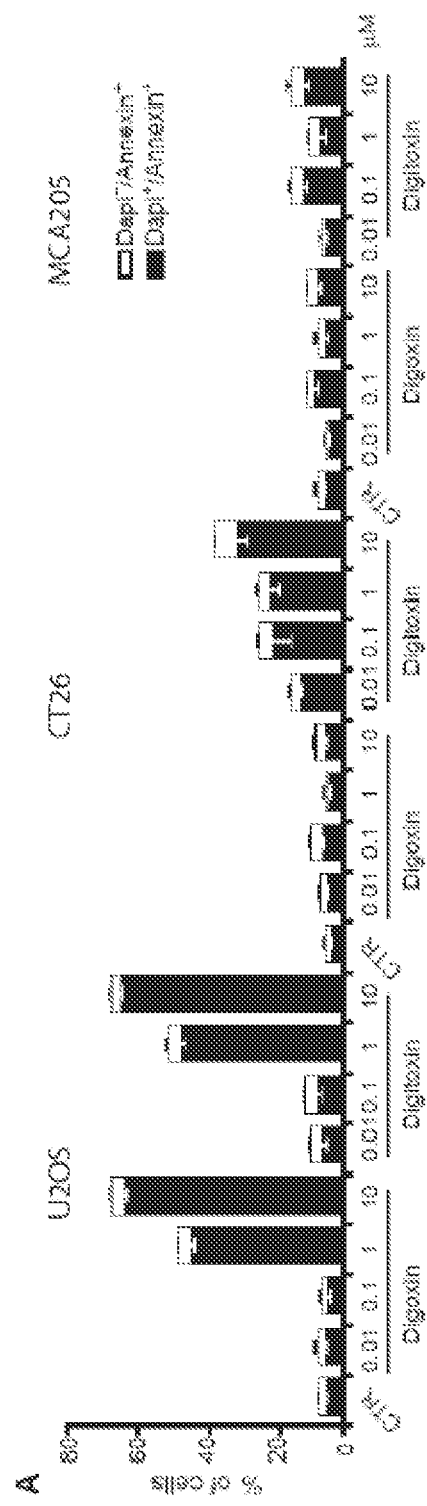
Figure 29:
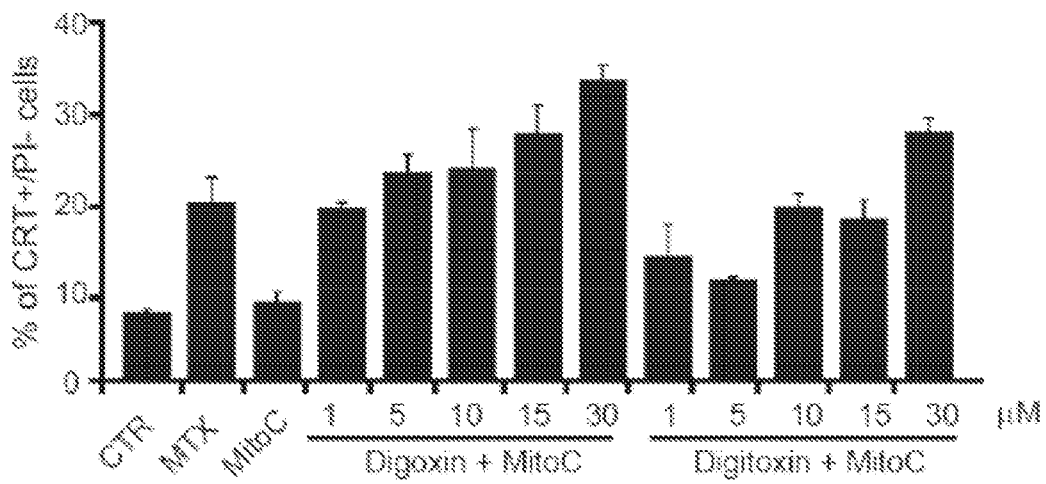
Figure 29:
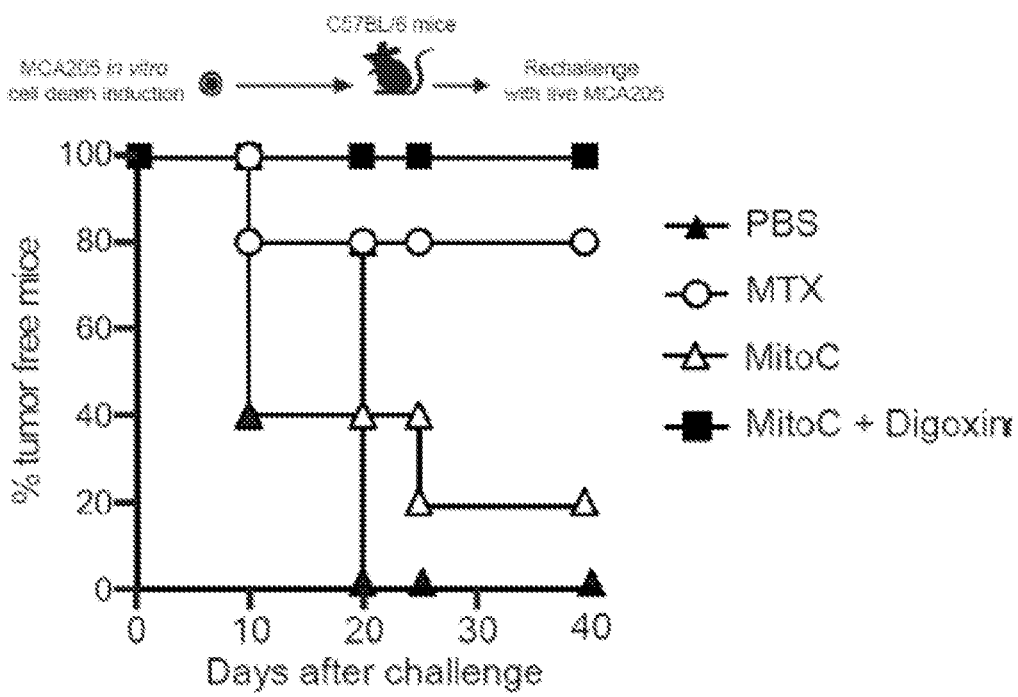
Figure 29:
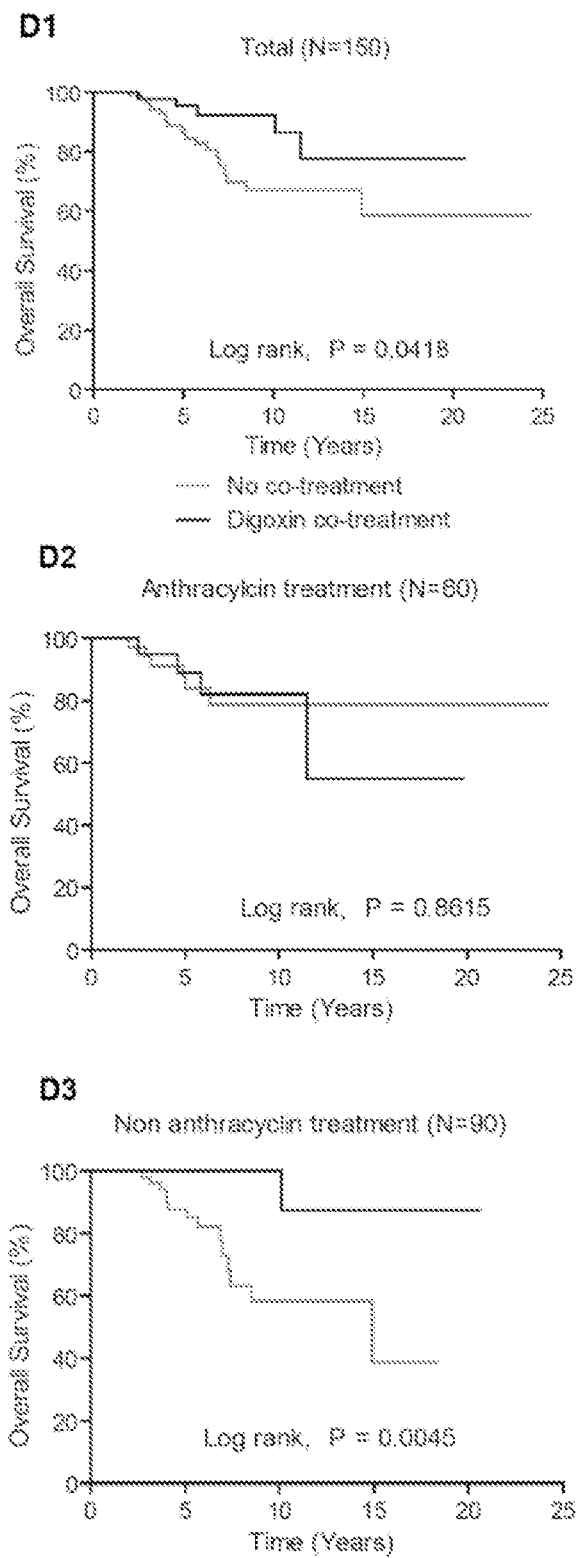

FIG. 29: Digoxin restores anti cancer immunogenicity in vivo.

(A) U2OS, CT26 and MCA cells have been treated for 24 h with the indicated concentration of drugs, and cell death has been assessed by measuring Annexin/DAPI by mean of FACS (B) CRT exposure was analysed in the cells that were single or cotreated as indicated by means of CRT surface staining and FACS quantification.

(C) MCA205 cells have been used for tumor vaccination in vivo. Cells treated over night (O/N) with 1 µM MTX, 20 µM MitoC with or without 30 µM Digoxin have been inoculated subcutaneously into the flank of C56BL/6 mice. The mice have been rechallenged after 6 days with living cells and the tumor growth is depicted in the survival plot (n=10). Digoxin used as single treatment caused tumor growth on the vaccination side and did not preclude the living cells from forming a tumor after rechallenge.

(D) D1: Overall survival of 150 breast cancer patients. 50 digoxin cotreated patients are opposed by 100 non digoxin treated controls.

Subgroup analysis depict anthracycline based chemotherapy with and without digoxin cotreatment and non anthracycline based therapy with and without digoxin cotreatment.

D2: Overall survival of 60 breast cancer patients anthracycline based chemotherapy. 20 digoxin cotreated patients are opposed by 40 non digoxin treated controls.

D3: Overall survival of 90 breast cancer patients non anthracycline based therapy. 30 digoxin cotreated patients are opposed by 60 non digoxin treated controls.

Figure 30:
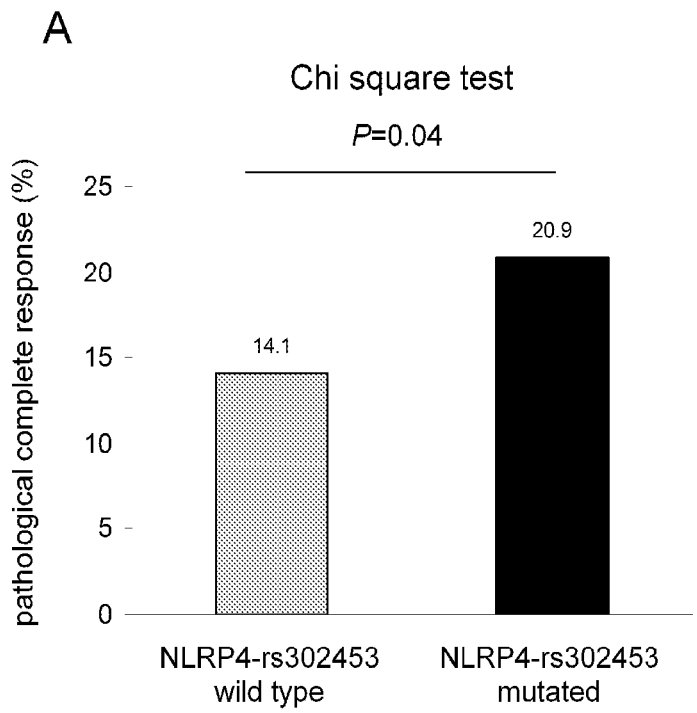

FIG. 30: The single-nucleotide polymorphism (SNP) in NLRP4 (rs302453) affects the efficacy of conventional anti-cancer therapy in terms of pathological complete response (pCR) in a neoadjuvant setting in breast cancer patients (n=443).

The NLRP4-rs302453 Gln925Leu polymorphism was genotyped in three cohorts (REMAGUS, Dijon, Houston).

A) The meta-analysis combining the results of the three studies revealed that the proportion of pathological complete responses was higher in NLRP4-rs302453 mutated group than in wild-type group of patients treated with anthracyclines. The Chi2 test was used.

B) The association between the NLRP4-rs302453 SNP and the pCR phenotype was confirmed by multivariate analyses using logistic regression by taking into account the effects of classical clinical factors. The NLRP4-rs302453 SNP appeared independently associated to pCR. The adjusted p-value, the odd ratio (OR) and the 95% confidence interval are displayed.

Figure 31:
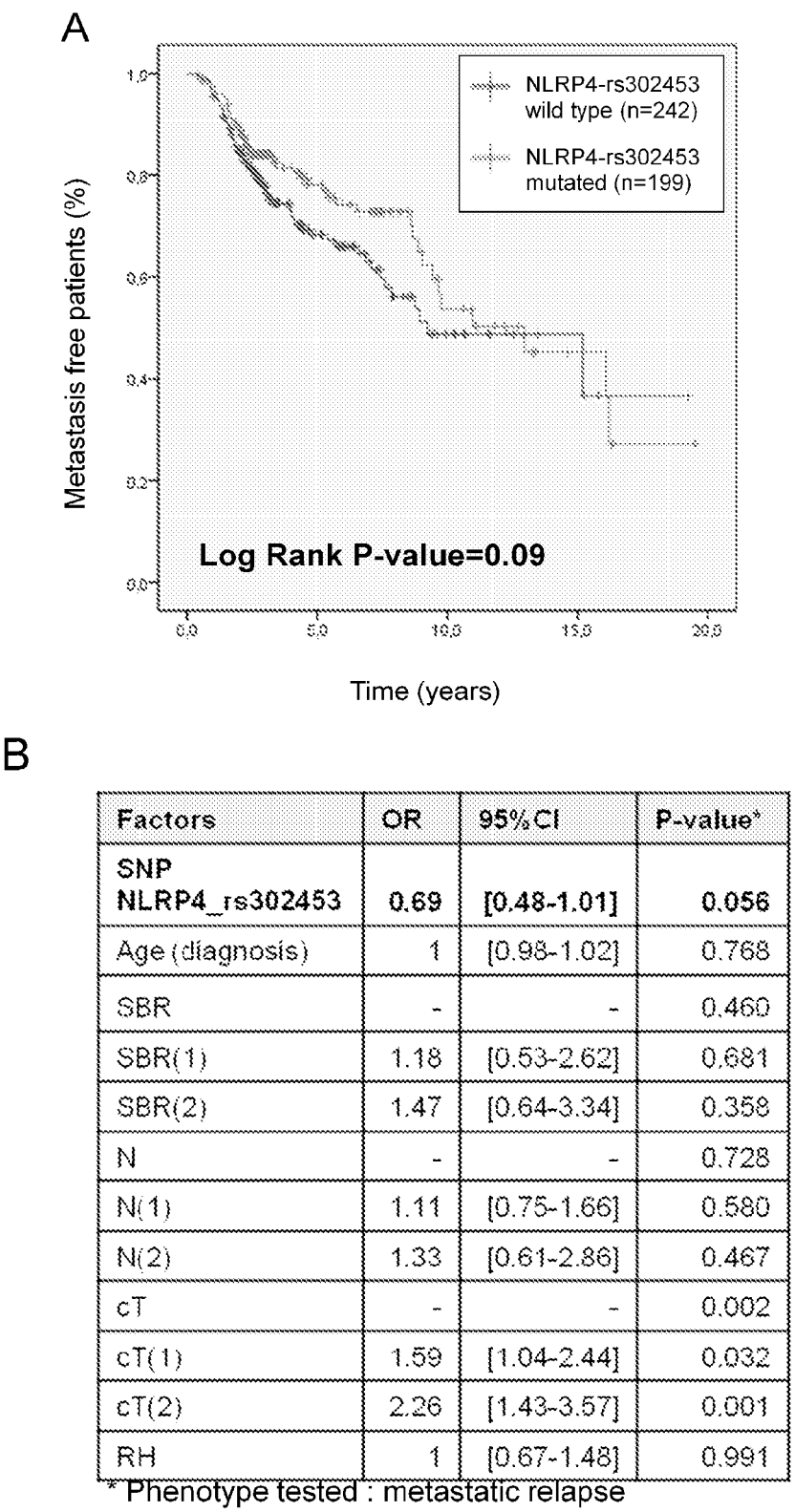

FIG. 31: The single-nucleotide polymorphism (SNP) in NLRP4 (rs302453) affects the efficacy of conventional anti-cancer therapy in terms of metastasis free survival in a neoadjuvant setting in breast cancer patients (n=441).

The meta-analysis combining the results of three survival studies based on univariate (A) and multivariate (B) approaches in REMAGUS, Dijon and Houston cohorts revealed that the NLRP4-rs302453 was associated with a lower frequency of metastasis in patients carrying the NLRP4 Gln925Leu mutated allele than in patient carrying the normal allele. The Log Rank test was used in the univariate analysis. The Kaplan-Meier curves are displayed (A). A Cox model was used in the multivariate analysis. The adjusted p-value, the odd ratio (OR) and the 95% confidence interval are displayed (B).

Figure 32:
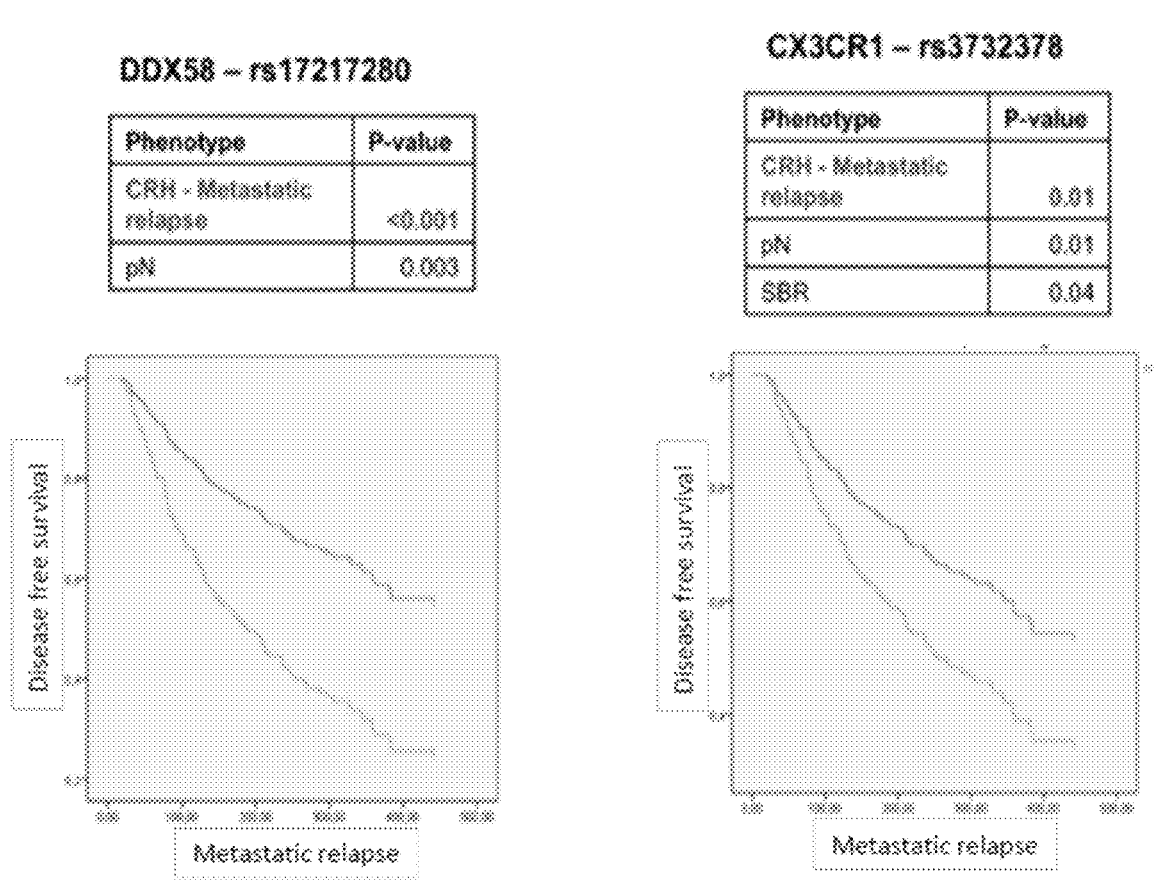

FIG. 32: Using a non biased selection of immune SNPs associated with shorter time to progression among a multiplex 356 SNP genotyping based on fluorescent PCR (Veracode Illumina) in a cohort of 280 N+adjuvant BC patients and 360 neoadjuvant BC, inventors identified two additional SNPs (located in DDX58/RIG-I and CX3CR1 encoding a cytosolic receptor detecting viral nucleic acids, and fractalkine respectively) in adjuvant and two highly significant SNPs in neoadjuvant (MTHFR: rs1801133 and FAT2: rs1432862) in a multivariate Cox model (integrating proliferation index and HR status).

Figure 33:
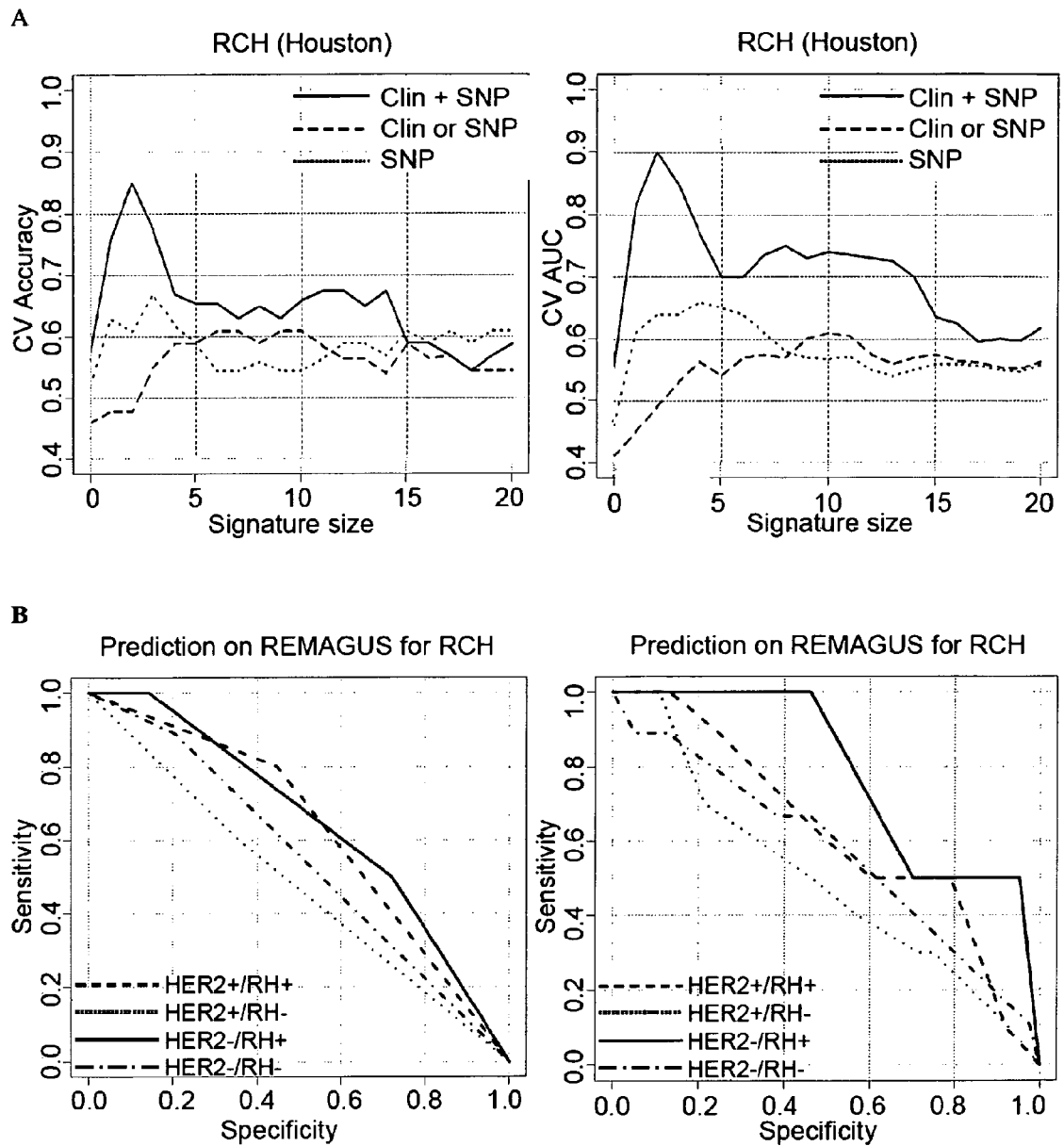
Figure 33:
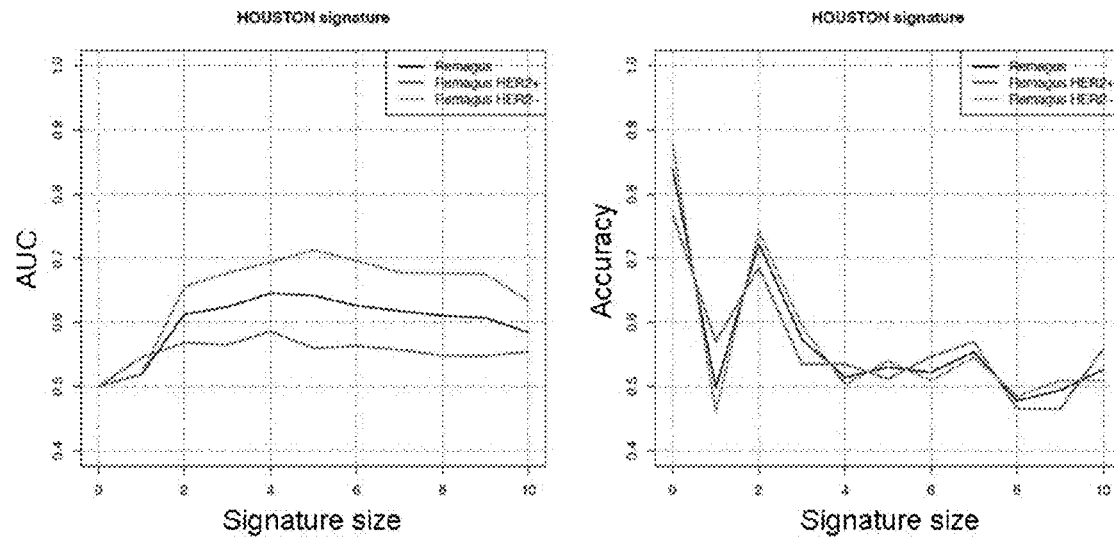
Figure 33:
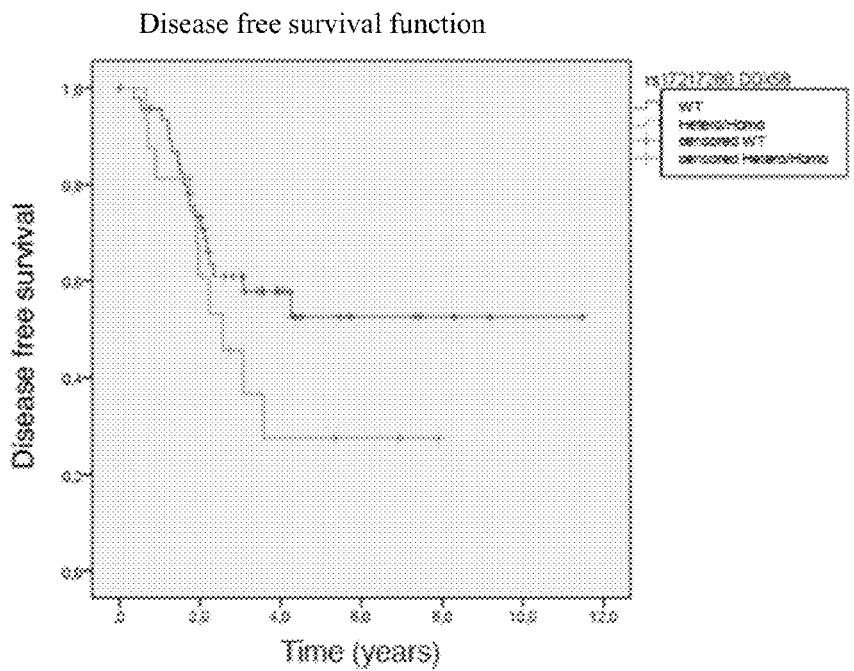

FIG. 33: The single-nucleotide polymorphism (SNP) in DDX58, CX3CR1 and FAT2 affects the efficacy of conventional anti-cancer therapy.

(A) Cross-validated accuracy and AUC for the three families of signatures, as a function of the number of factors in the signature, for the RCH endpoint.

(B) ROC curves for the RCH signature trained on HOUSTON and tested on REMAGUS. Inventors compare the purely clinical signature (left) to the clinical+2 SNP signature (right)

(C) AUC (left) and accuracy (right) of the signatures of various sizes trained on HOUSTON, and tested on REMAGUS.

(D) Predictive value of DDX58 and FAT2 in a third independent cohort (Dacier cohort) of neoadjuvant breast cancer (BC) as predictive factors of disease free survival.

Figure 34:
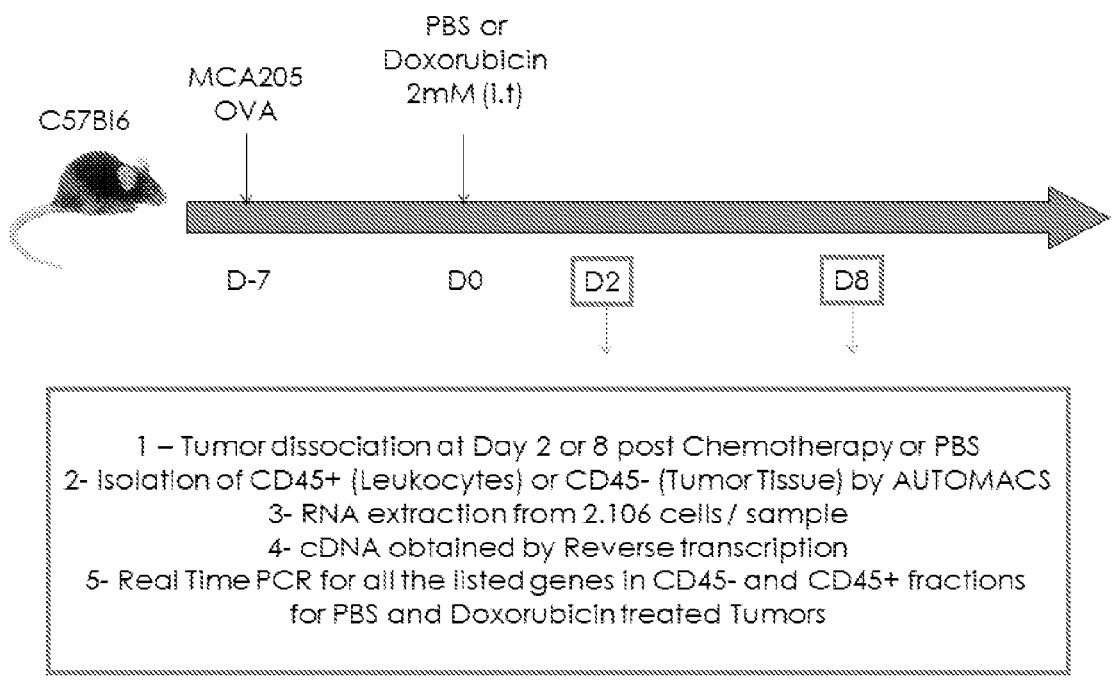

FIG. 34: Experimental Setting 0.8 Million of MCA 205 were subcutaneously implanted to C57B16 mice. When tumors reached 36 to 42 mm$^2$ (about 7 days later), mice were intratumoraly treated by either PBS or Doxorubicin (2 mM, 50 µl) (4 groups: PBS or Doxo Treated. Day 2 or Day 8 post treatment, 6 mice/group). RNA was extracted from each tumor samples using RNeasy Mini Kit (QIAGEN) and RNA concentration and purity was tested by NanoDrop Spectrophotometers (Thermo Scientific). mRNA was reverse transcribed into cDNA. qRT-PCR was then performed on diluted cDNA (45 cycles with standard PCR program using StepOnePlus™ system (Applied Biosystems) using primer and probe TAQMAN. PPIA was used as endogenous control gene to normalize gene expression for data analysis (see example 7).

Figure 35:
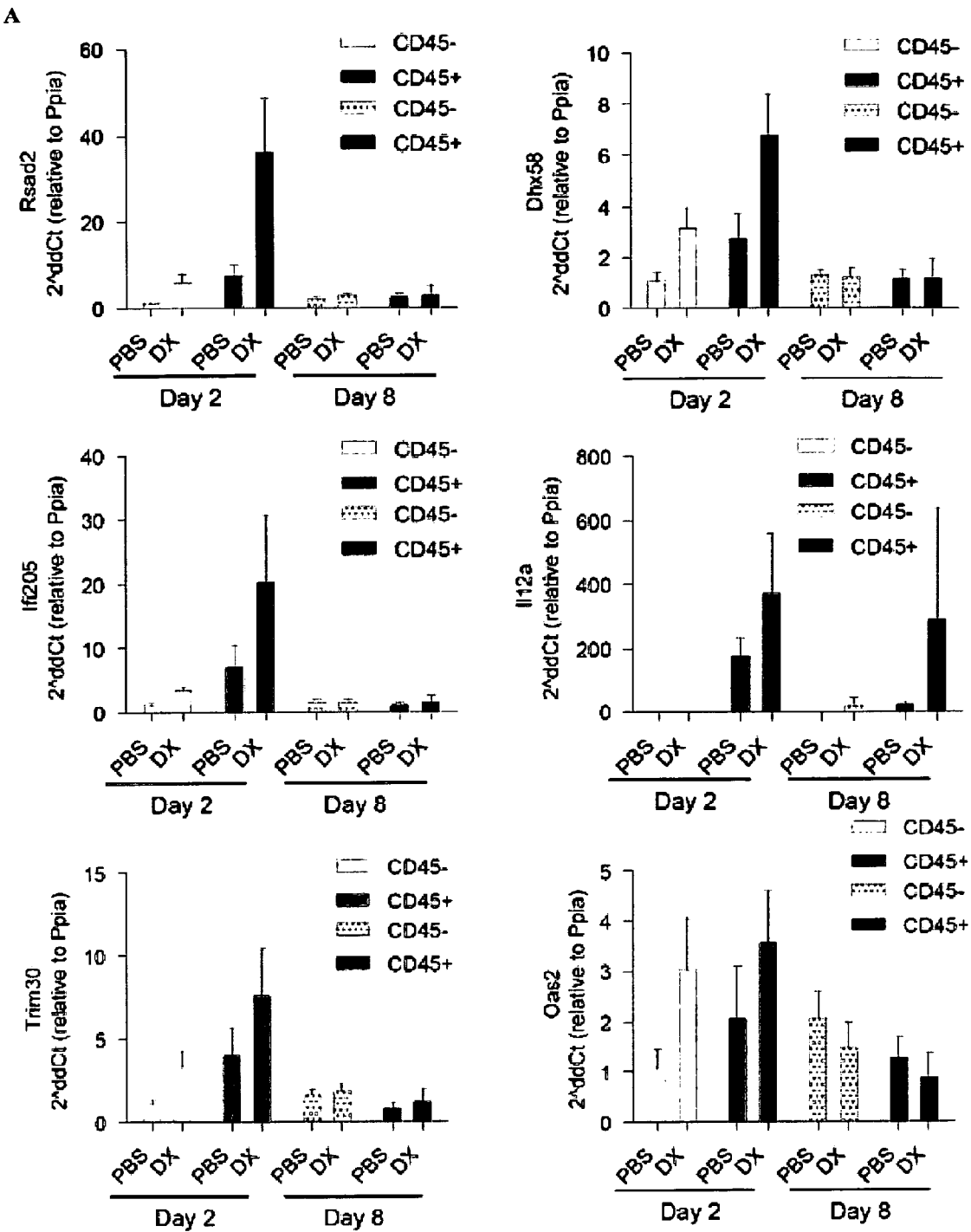
Figure 35:
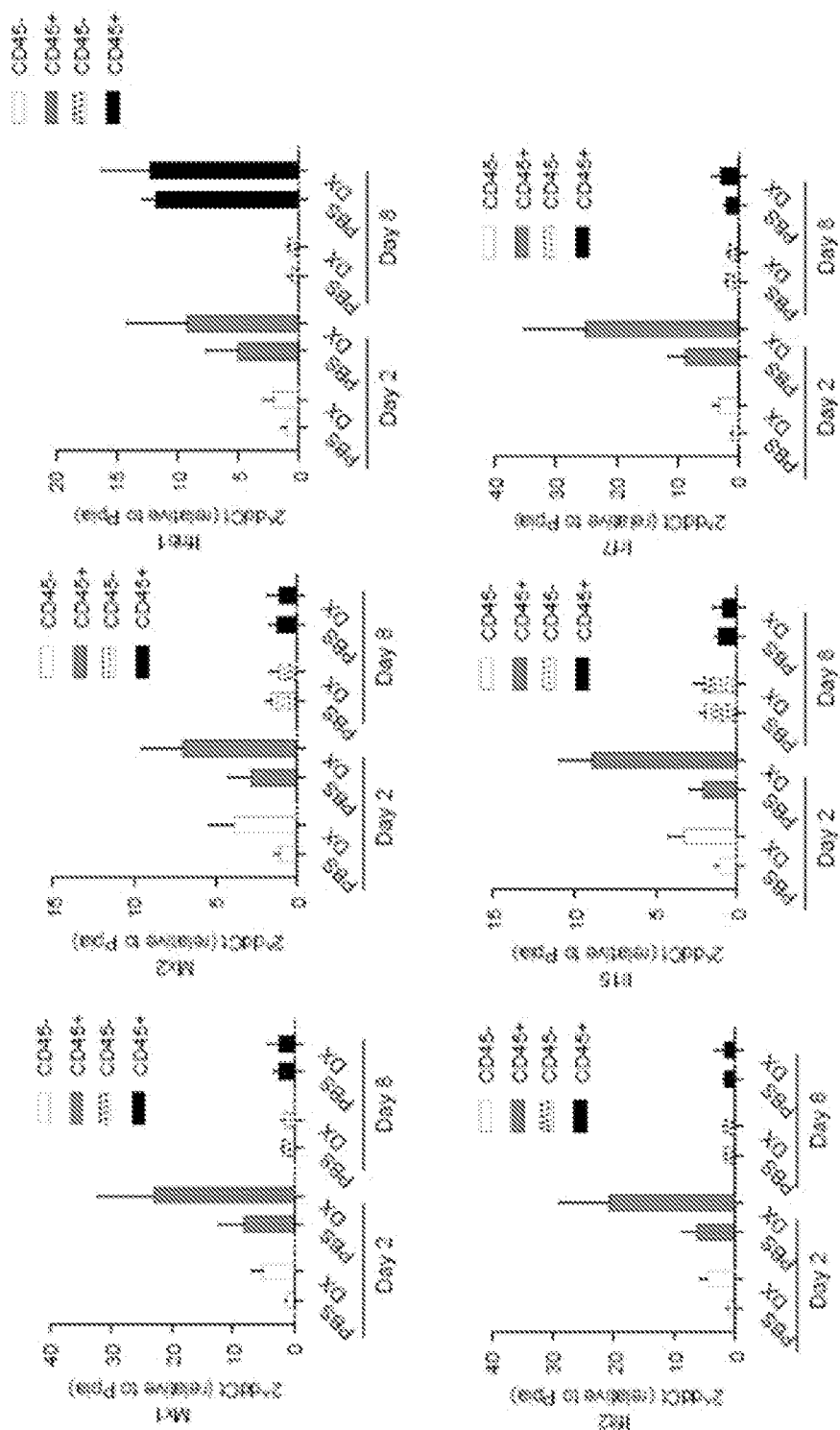
Figure 35:
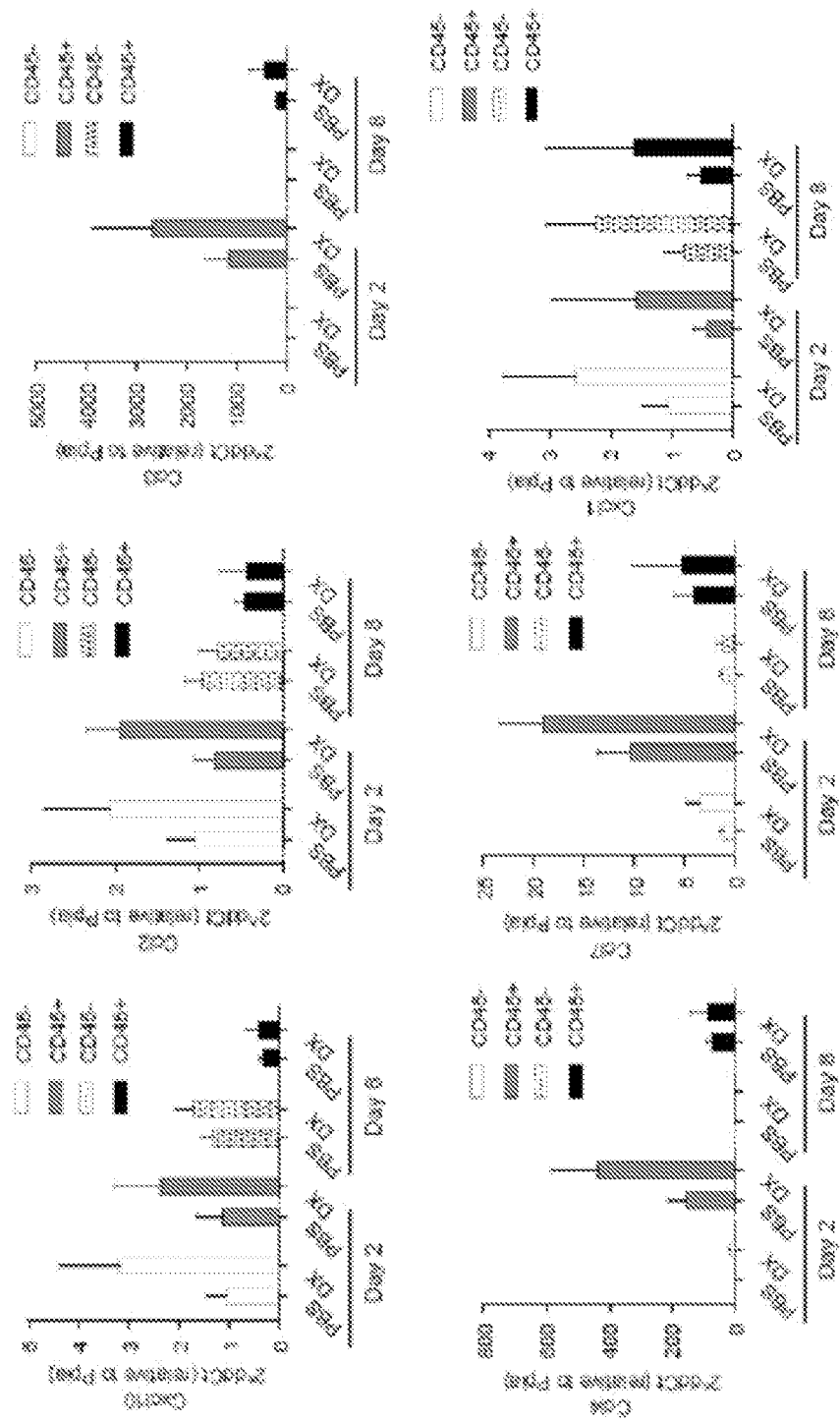
Figure 35:
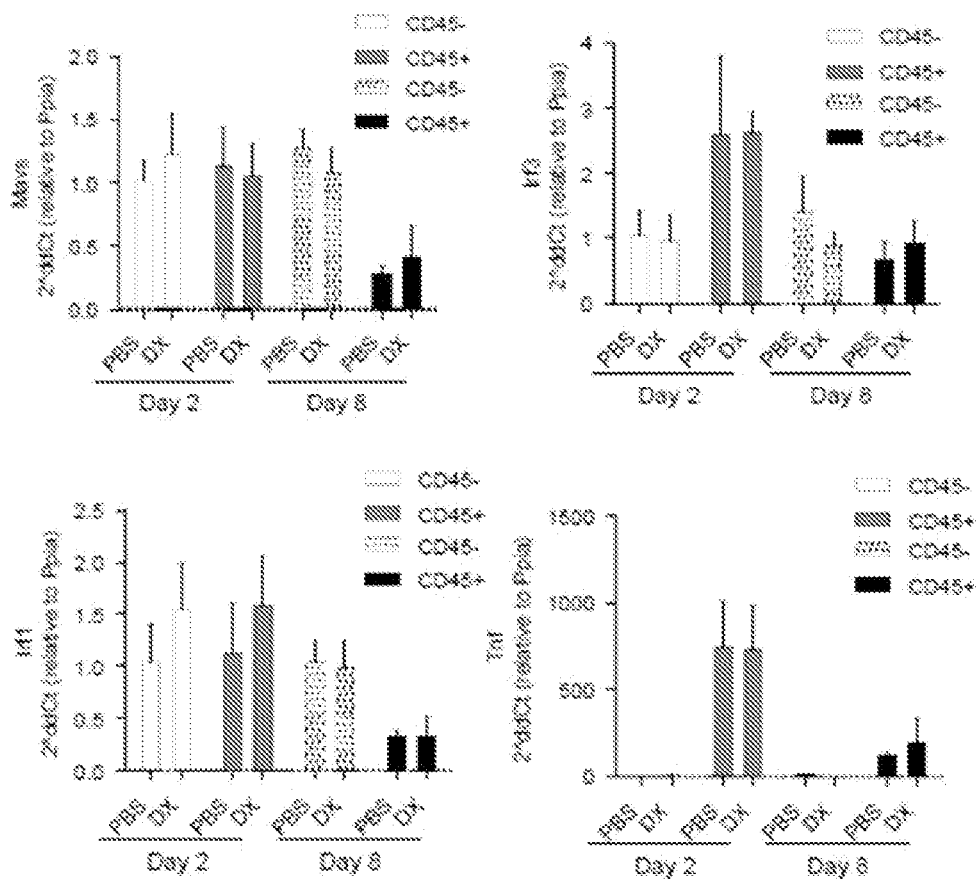

FIG. 35: Genes regulated 2 and 8 days after doxorubicin treatment.

(A) Rsad2, Dhx58, Ifi205, Il12a, Trim30 and Oas2 genes are specifically up-regulated in the CD45+ fraction 2 days after doxorubicin treatment. DX: doxorubicin. (n=6 mice)

(B) Mx1, Mx2, Ifnb1, Ifit2, Il15, Irf7 genes are specifically up-regulated in the CD45+ fraction 2 days after doxorubicin treatment. DX: doxorubicin. (n=6 mice)

(C) Cxcl10, Ccl2, Ccl3, Ccl4, Ccl7 and Cxcl1 genes are specifically up-regulated in the CD45+ fraction 2 days after doxorubicin treatment. DX: doxorubicin. (n=6 mice)

(D) Mavs, Irf1, Tnf and Irf3 are unchanged in the CD45+ fraction 2 days after doxorubicin treatment. DX: doxorubicin. (n=6 mice)

Figure 36:
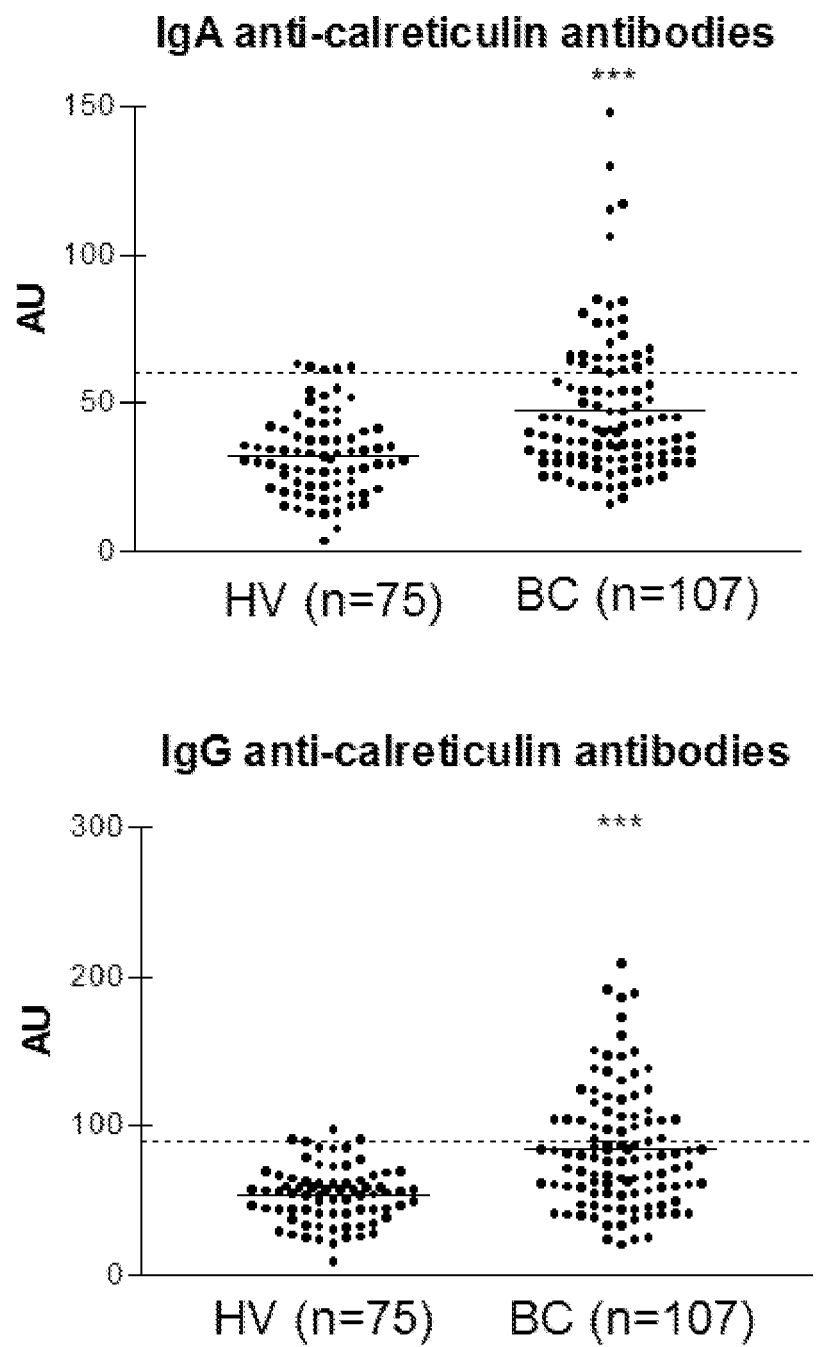

FIG. 36: IgA and IgG dosage in sera from Healthy Volunteers (HV) and Breast Cancer Patients (BC). Cut-off values were calculated as 60 AU for IgA anti-CRT antibodies and 90 AU for IgG anti-CRT antibodies.

Figure 37:
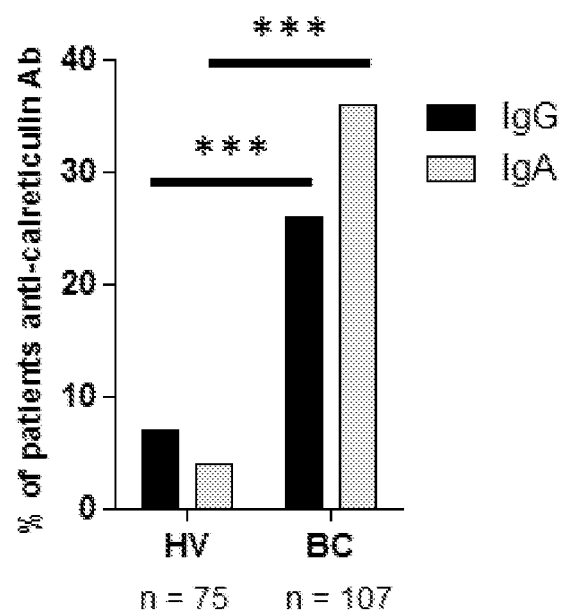

FIG. 37: Percentage of positive samples for anti-Calreticulin IgA and IgG in Healthy Volunteers (UV) and Breast Cancer Patients (BC). Cut-off values were calculated as 60 AU for IgA anti-calreticulin antibodies and 90 AU for IgG anti-calreticulin antibodies.

Figure 38:
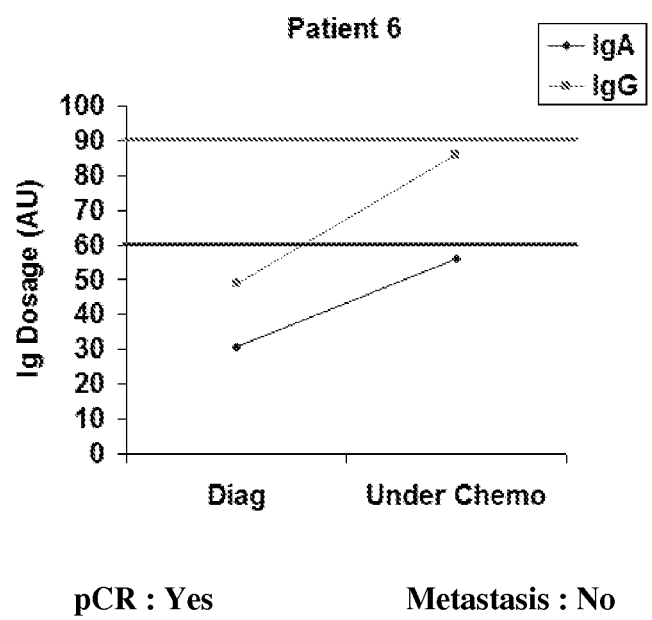
Figure 38:
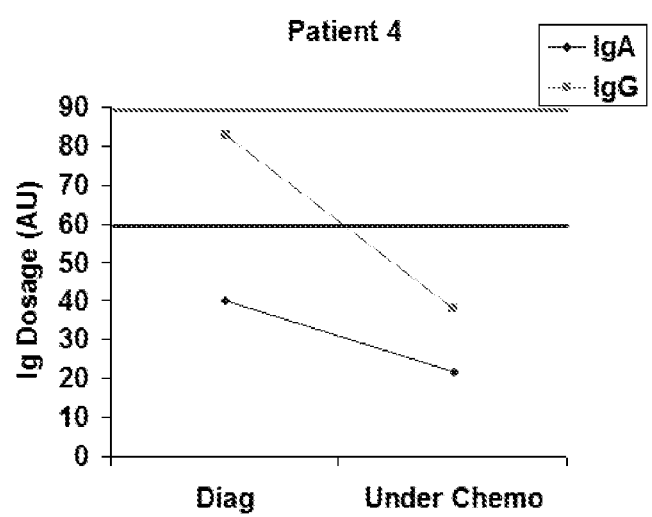

FIG. 38: The level of 1 g anti-Calreticulin at the diagnosis and the capacity to develop a humoral response during chemotherapy treatment are associated to clinical response to anthracyclines and metastasis free survival. pCR: pathological Complete Response.

Figure 39:
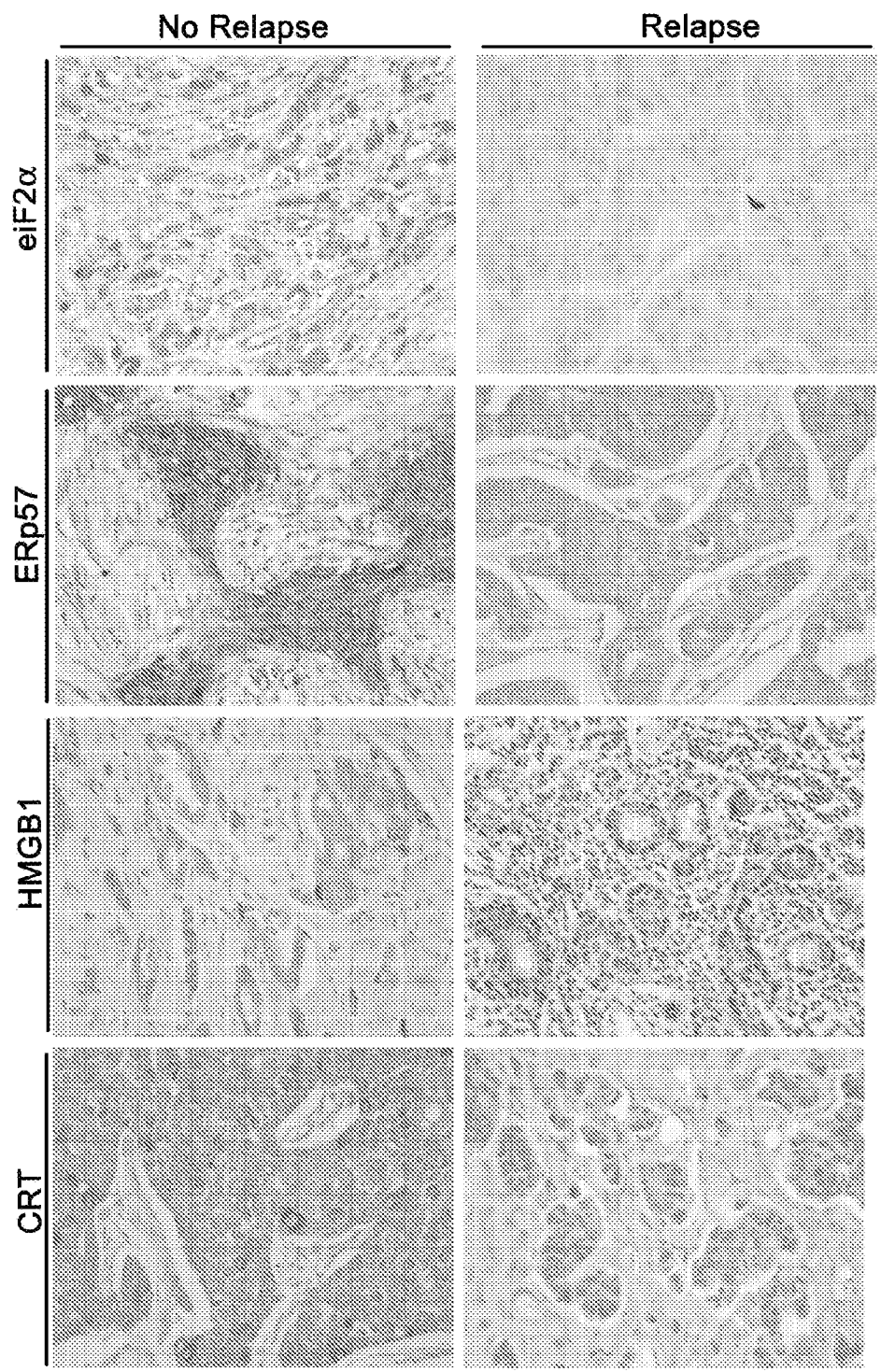
Figure 39:
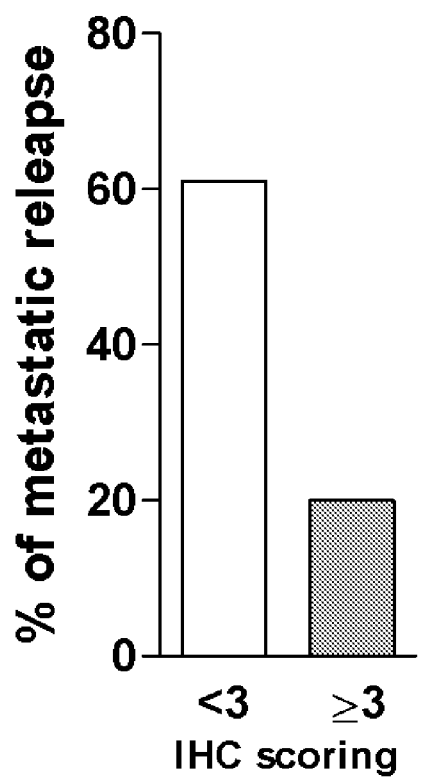

FIG. 39: (A) Immunohistochemistry of ER stress response markers (eif2a phosphorylation, CRT, ERp57 and HMGB1) in BC at diagnosis in FFPE (B) The panel is a graph summarizing scoring FIG. 40: The core machinery of autophagy is indispensable for ATP release during exposure with immunogenic chemotherapies.

Figure 40:
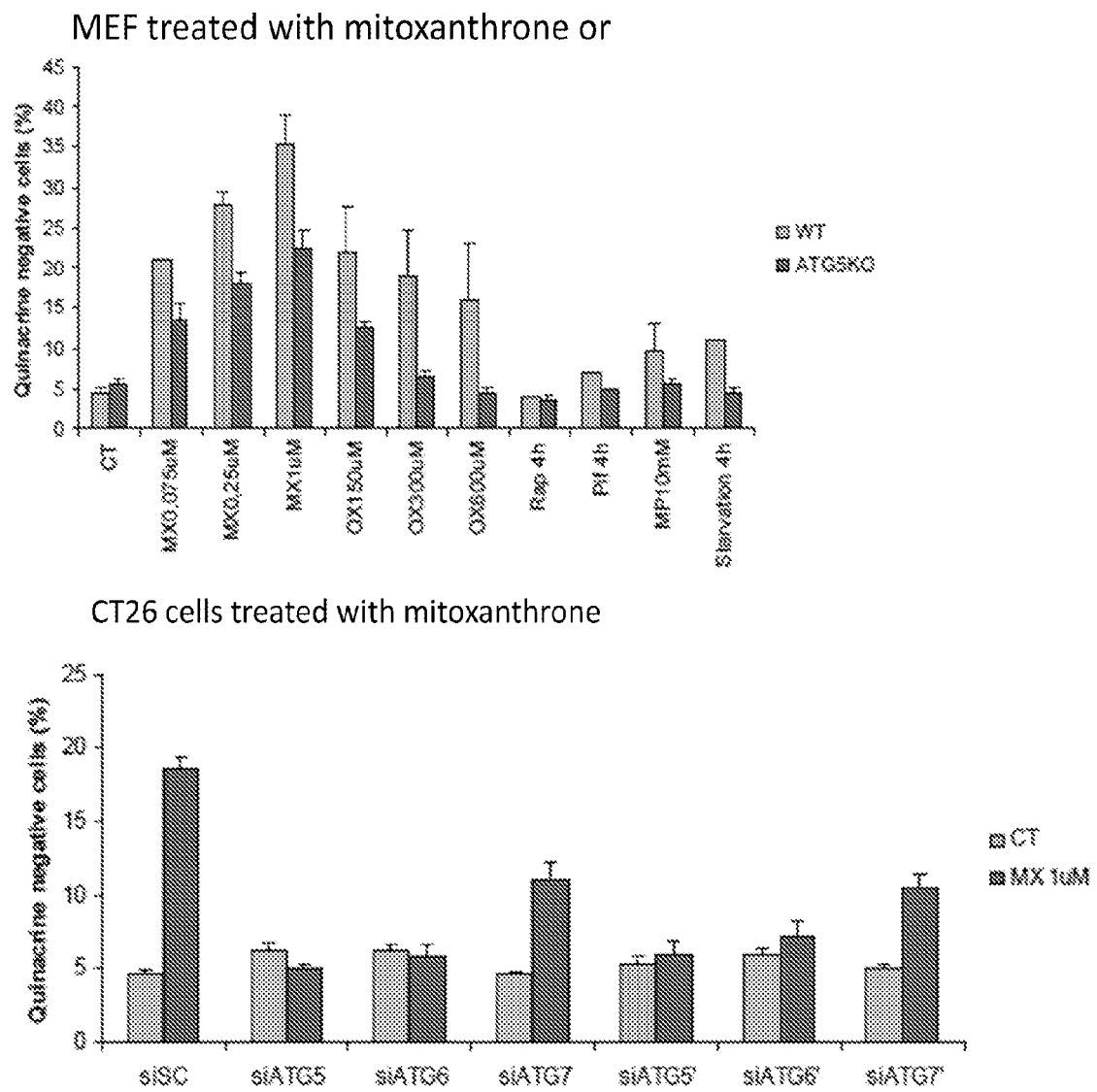

FIG. 40 upper panel. The percentages of Quinacrine negative cells, assessed by immunofluorescence (GFP emission) represent the proportions of cells that have lost intracellular ATP. The positive control for autophagy induction is starvation.

FIG. 40 lower panel. ATP release is indirectly measured by the percentages of cancer cells that have lost quinacrine expression.

Figure 41:
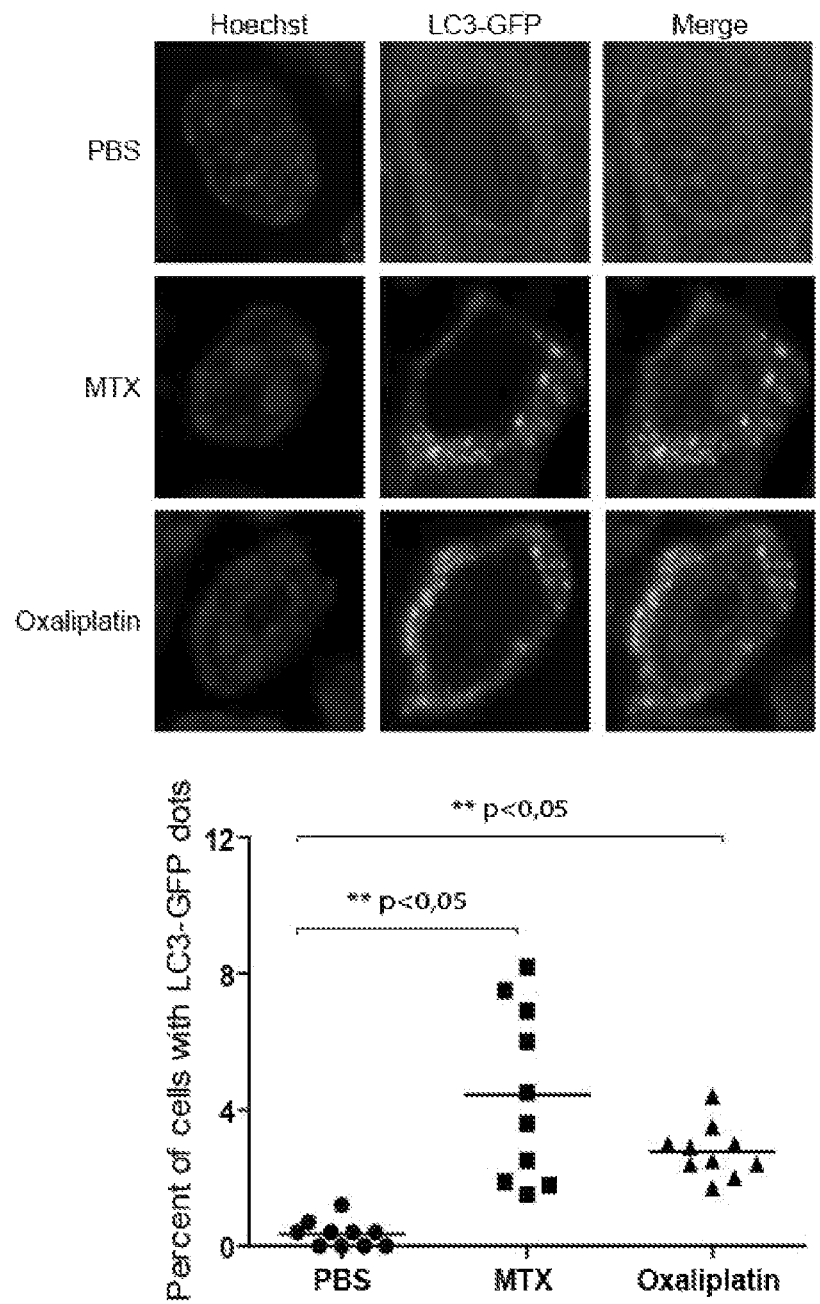

FIG. 41: Induction of autophagy in vivo following chemotherapy of established tumors. Redistribution of LC3-GFP in autophagosomes can be visualized post-therapy with both cytotoxic agents (mitoxanthrone MTX and oxaliplatin) as shown in representative micrograph pictures (upper panels). The lower panel is a graph summarizing enumeration of autophagosomes positive cells in 10 independent sections per tumor and animal (each dot represents one tumor). Statistical analyses were performed with Anova test (Fisher's exact method) with significant results at p<0.05.

Figure 42:
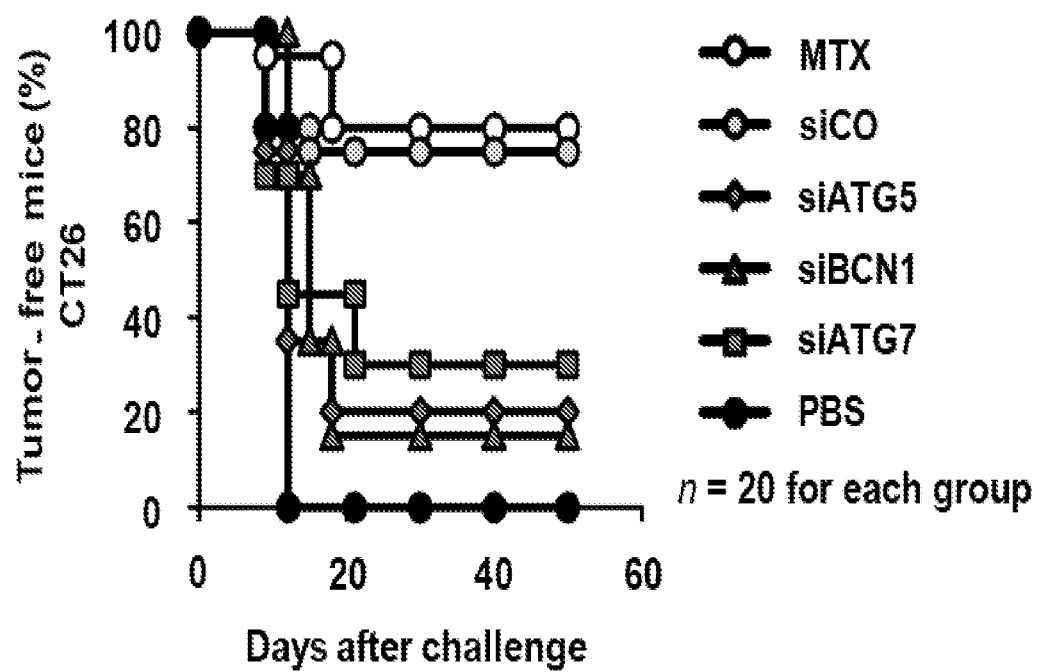

FIG. 42: Prophylactic immunization with dying tumor cells is impaired when dying cells are autophagy-deficient.

The % of tumor free animals are shown in the graph and the number of animals per group is indicated (n=20). Statistical analyses were performed with Anova test (Fisher's exact method) with significant results at p<0.05.

Figure 43:
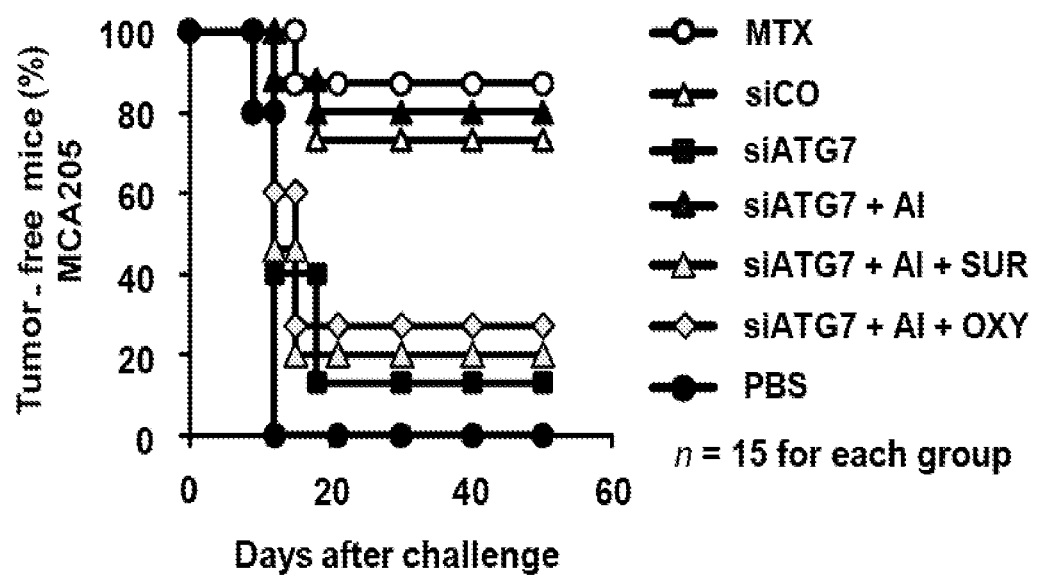

FIG. 43: Compensatory therapy for autophagy deficient cells: apyrase inhibitors restore the immunogenicity of autophagy-deficient dying tumor cells.

The % of tumor free animals are shown in the graph and the number of animals per group is indicated (n=20). Statistical analyses were performed with Anova test (Fisher's exact method) with significant results at p<0.05.

Figure 44:
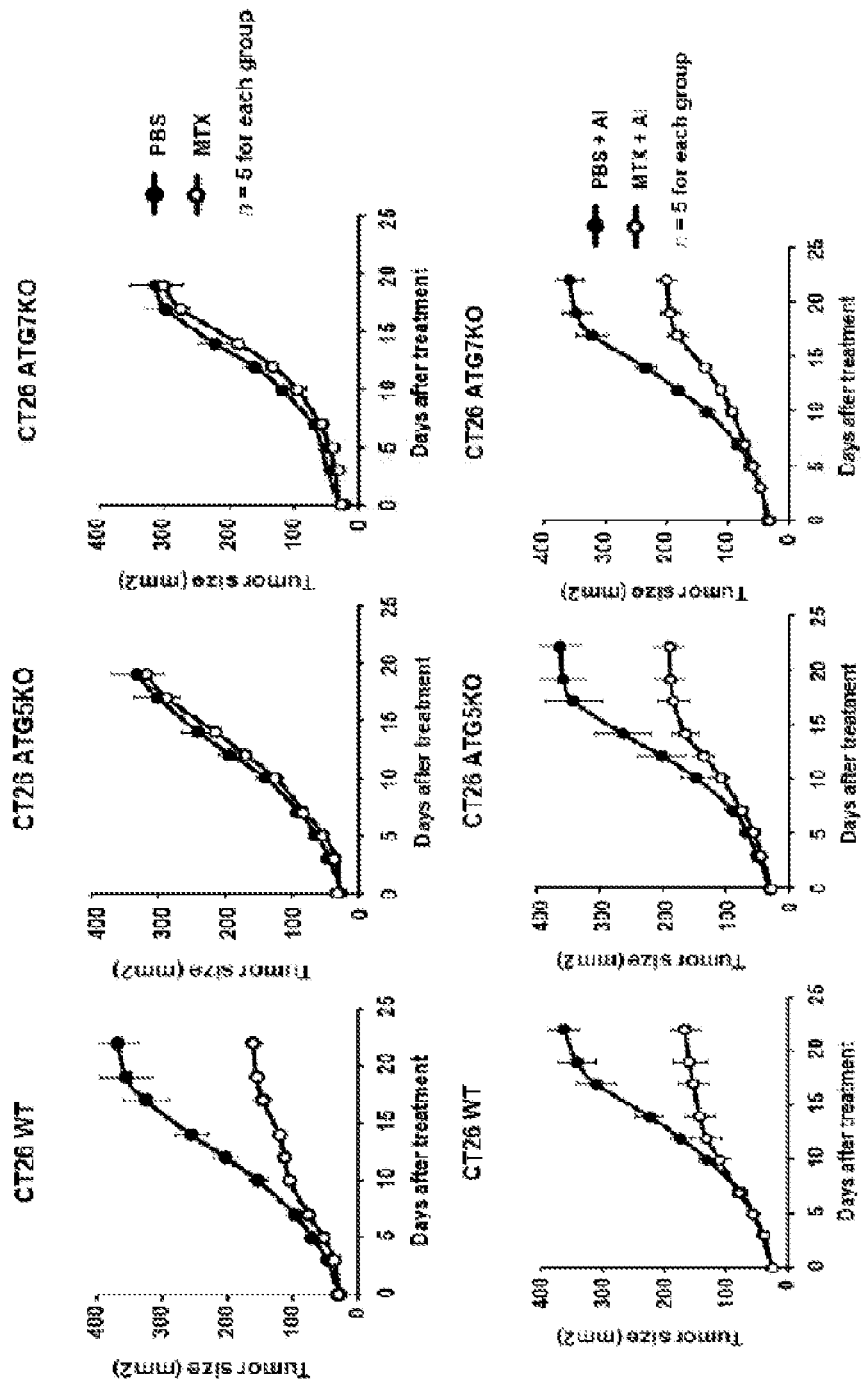

FIG. 44: Autophagy-deficient tumors failed to properly respond to chemotherapy unless apyrase inhibitors are coadministered along with chemotherapy.

Left graphs show that when apyrase inhibitors (AI) are co-administered locally in tumor beds along with chemotherapy (iv inoculated), tumors start to regress with the cytotoxic agent. Monitoring of tumor growth was recorded with a caliper (product of perpendicular diameters) and is depicted for 5 mice/group. Statistical analyses were performed with Anova test (Fisher's exact method) with significant results at p<0.05.

Figure 45:
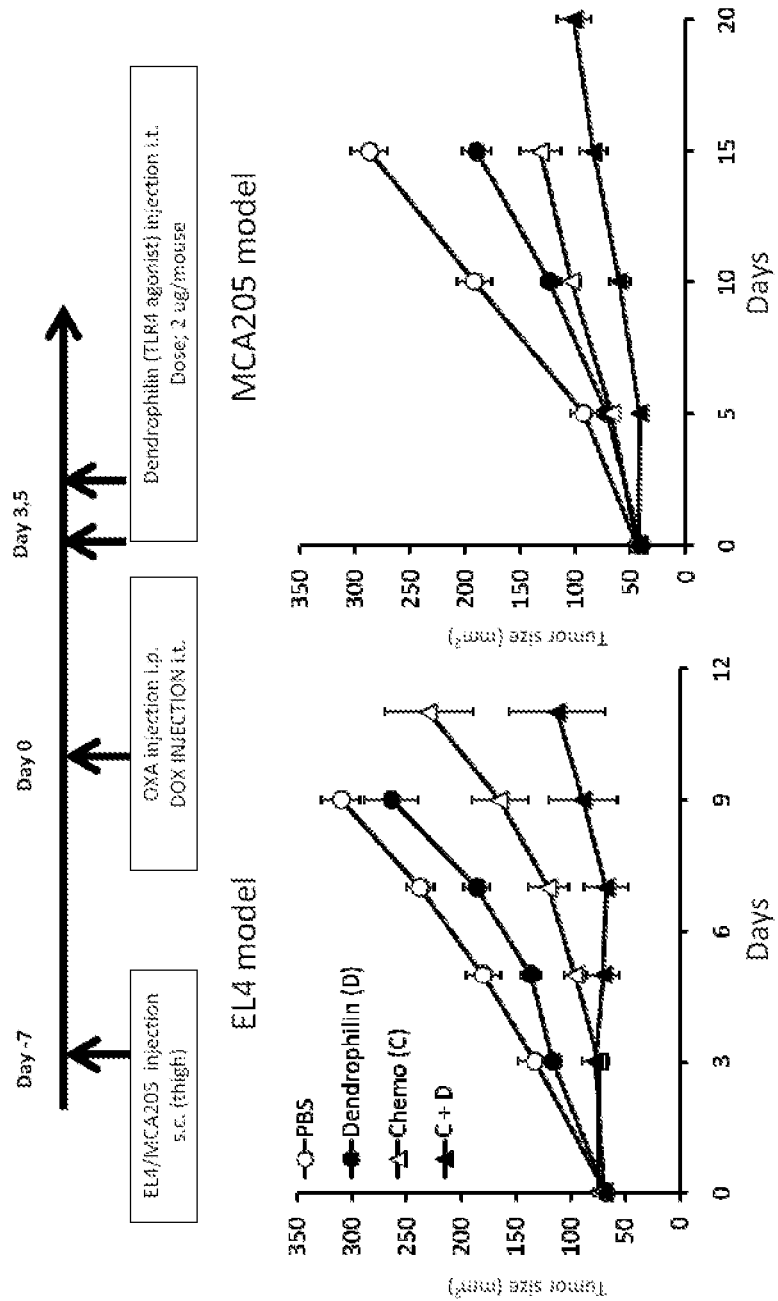

FIG. 45: TLR4 agonists potentiate the immunogenicity of anthracyclines and oxaliplatine PBS treated mice cannot control the tumor growth whereas chemotherapy-treated mice are able to do so. Dendrophilin combined with Chemotherapy increases the control of the tumor growth, meaning that TLR4 agonists potentiate the immunogenicity of anthracyclines and oxaliplatin in 2 tumor models.

Figure 46:
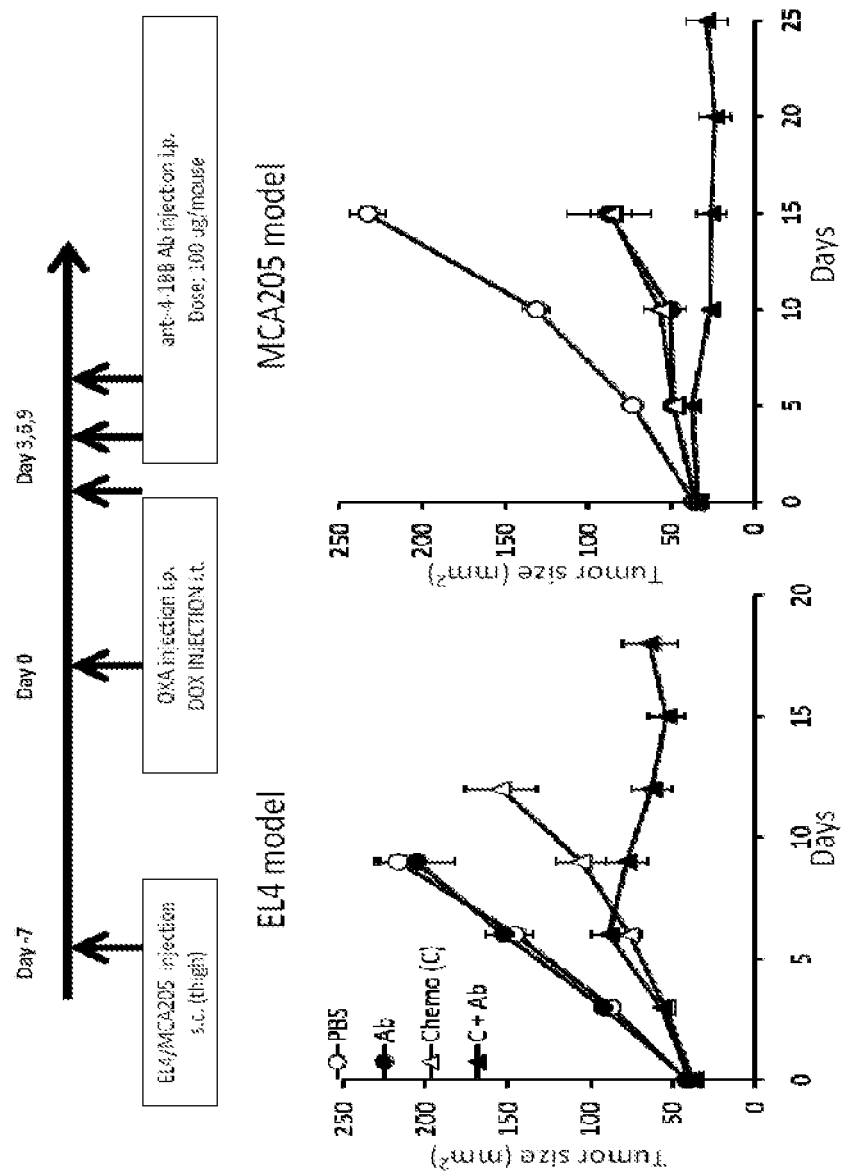

FIG. 46: 4-1BB agonists potentiate the immunogenicity of anthracyclines and oxaliplatine PBS treated mice cannot control the tumor growth whereas chemotherapy-treated mice are able to do so. 4-1BB agonist combined with Chemotherapy increases the control of the tumor growth, meaning that 4-1BB agonists potentiate the immunogenicity of anthracyclines and oxaliplatin in 2 tumor models.

DETAILED DESCRIPTION OF THE INVENTION

Inventors have herein discovered an ordered sequence of molecular events in the pathway leading to the immunogenic cell death of tumour cells.

This pathway may be interrupted at several levels, by the loss of a positive mediator or by the presence of an inhibitor of such a positive mediator. The result of such an interruption will be the absence of reaction of the subject's immune system, in other words, the absence of "immunogenic cell death".

Inventors herein below identify particular products the detection of which can be used to determine if a subject will respond or not to a cancer treatment.

Inventors further herein below provide methods which can be used (i) to determine the presence of an immunogenic response in a subject having a tumor, (ii) to determine the presence or level of exposure of particular proteins on the surface of tumour cells or of immune cells (as herein defined), (iii) to determine the presence or level of expression of particular proteins secreted by tumor cells or immune cells, (iv) to determine the susceptibility of a tumour cell to a cancer treatment, and/or (v) to determine if a subject will respond to a cancer treatment or will be resistant to said treatment.

"Immunogenic Cell Death"

Cell death can be classified according to the morphological appearance of the lethal process (that may be apoptotic, necrotic, autophagic or associated with mitosis), enzymological criteria (with and without the involvement of nucleases or distinct classes of proteases, like caspases), functional aspects (programmed or accidental, physiological or pathological) or immunological characteristics (immunogenic or non-immunogenic) (Kroemer et al., 2009).

Thanks to the advancing comprehension of cellular demise, it has become clear that the textbook equation 'programmed cell death=apoptosis=caspase activation=non-immunogenic cell death', although applicable to some instances of cell death, constitutes an incorrect generalization, at several levels (Garg et al., 2009). Thus, necrosis can be programmed both in its course and its occurrence (Vandenabeele et al., 2008). Apoptosis can be lethal without caspase activation, and caspase activation does not necessarily cause cell death (Kroemer and Martin, 2005) Finally, cell death with an apoptotic appearance can be immunogenic (Casares et al., 2005). These examples illustrate the urgent need to strive towards a more detailed comprehension of cell death subroutines.

Cell death is defined by Casares et al. (2005) as "immunogenic" if dying cells that express a specific antigen (such as the model antigen ovalbumin OVA or a tumor antigen), yet are uninfected (and hence lack pathogen-associated molecular patterns), and are injected subcutaneously into mice, in the absence of any adjuvant, cause a protective immune response against said specific antigen. Such a protective immune response precludes the growth of living transformed cells expressing the specific antigen injected into mice.

Inventors demonstrate that when cancer cells succumb to an immunogenic cell death (or immunogenic apoptosis) modality, they alert the immune system, which then mounts a therapeutic anti-cancer immune response and contributes to the eradication of residual tumor cells. Conversely, when cancer cells succumb to a non-immunogenic death modality, they fail to elicit such a protective immune response.

"Anti-Cancer Immune Response"

The response from the immune system is herein called an "anti-cancer immune response" when it is directed against tumour cells, in particular cancerous cells. The anticancer immune response is allowed by a reaction from the immune system of the subject to the presence of cells, preferably of tumor cells, dying from an immunogenic cell death (as defined previously).

Preferably, the anti-cancer immune response allows, at least partly, the regression or destruction of the tumor.

In the context of the present invention, the patient or subject is a mammal. In a particular embodiment, the mammal is a human being, whatever its age or sex. The patient may have a tumor. Unless otherwise specified in the present disclosure, the tumor is a malignant tumor.

An in vitro or ex vivo method of assessing the sensitivity of a subject having a tumor to a treatment of cancer is herein provided as a particular embodiment. This method comprises a step of detecting the presence of an anticancer immune response of the subject, the absence of an anticancer immune response being indicative of a resistance of the subject to the treatment of cancer.

Within the context of this invention, "non-responder" or "resistant" refers to the phenotype of a subject who does not respond to a treatment of cancer, in particular to a conventional treatment of cancer as previously defined, i.e. the volume of the tumor does not substantially decrease, or the symptoms of the cancer in the subject are not alleviated, or the cancer progresses, for example the volume of the tumor increases and/or the tumor generates local or distant metastasis. The terms "non-responder" or "resistant" also refer to the phenotype of a subject who will die from the cancer.

Within the context of this invention, "responder" or "sensitive" refers to the phenotype of a patient who responds to a treatment of cancer, in particular to a conventional treatment of cancer as previously defined, i.e. the volume of the tumor is decreased, at least one of his symptoms is alleviated, or the development of the cancer is stopped, or slowed down.

A subject who responds to a cancer treatment is, in the sense of the present invention, a subject who typically has a much longer disease free survival chance than a patient who has been identified, with a method as herein described, as resistant to a treatment of cancer. Typically, a subject who responds to a cancer treatment is a subject who will be completely treated (cured). Within the context of this invention, the term pathological complete response ("pCR") means that the tumor size dramatically decreases under chemotherapy, typically after a neoadjuvant chemotherapy, and then becomes operable or undetectable.

Typically, a subject who responds to a cancer treatment is a subject who will be completely treated (cured), i.e., a subject who will survive to the cancer [the detected or measured parameter (for example the expression product of gene as herein disclosed) has a beneficial impact on the "overall survival" (OS)].

A subject who responds to a cancer treatment is also, in the sense of the present invention, a subject who typically has a much longer disease free survival (DFS) or metastasis free survival chance than a patient who has been identified, with a method as herein described, as resistant to a treatment of cancer.

The sensitivity or susceptibility of a subject to a treatment of cancer indicates whether the subject is "responder" or "non-responder", in other words whether the subject will or will not, be at least partially treated (tumor growth retardation or regression), preferably be completely treated (cured), by said cancer treatment.

In a particular and preferred embodiment of the present invention, the subject is typically a subject undergoing a treatment of cancer, in particular a conventional treatment of cancer (preferably chemotherapy and/or radiotherapy). This means that, typically, before assessing the sensitivity of the subject to a particular treatment of cancer, this subject has been exposed to said particular treatment of cancer. The subject may have been exposed to part of a complete conventional treatment protocol, for example to at least one cycle of the all treatment protocol, for example two cycles of the all treatment protocol.

In another particular embodiment of the present invention, the method of assessing the sensitivity of a subject to a treatment of cancer is applied on a subject who has not been previously exposed to a treatment of cancer. Preferably the serum of such a subject is free of anti-CRT antibodies.

Methods herein described are predictive methods, i.e., methods capable of assessing the ability of a subject to mount an immune response in the context of an anthracycline, oxaliplatine or X Rays treatment as herein defined and not only prognostic methods, only capable of indicating whether the subject will survive to the cancer or die from the cancer.

In the context of the present invention, a "conventional treatment of cancer" may be selected from a chemotherapy, a radiotherapy, an hormonotherapy, an immunotherapy, a specific kinase inhibitor-based therapy, an antiangiogenic agent based-therapy, an antibody-based therapy, in particular a monoclonal antibody-based therapy, and surgery.

The term "conventionally" means that the therapy is applied or, if not routinely applied, is appropriate and at least recommended by health authorities. The "conventional" treatment is selected by the cancerologist depending on the specific cancer to be prevented or treated.

In the present invention, the cancer is a cancer that is usually or conventionally treated with one of the following therapy: a chemotherapy, a radiotherapy, an hormonotherapy, an immunotherapy, a specific kinase inhibitor-based therapy, an antiangiogenic agent based-therapy, an antibody-based therapy and a surgery.

The cancer may be any kind of cancer or neoplasia. The cancer is preferably selected from a breast cancer, a prostate cancer, an oesophagus cancer, a colon cancer, a rectal cancer, a kidney cancer, a lung cancer, in particular a non-small cell lung cancer (NSCLC), a thyroid cancer, an osteosarcoma, a gastrointestinal sarcoma (GIST), a melanoma, a leukaemia, in particular an acute lymphoid leukaemia, an Hodgkin lymphoma, and a neuroblastoma.

The tumour cell mentioned in the present invention is a cell obtained from a tumor of a subject suffering from a cancer, in particular from at least one of the previously identified cancers. The tumor cell is preferably selected from a carcinoma, a sarcoma, a lymphoma, a melanoma, a paediatric tumour and a leukaemia tumour.

It is to be understood that the expression "tumor cells" used to identify cells obtained from a tumor of a subject, is also used, in the present description, to identify circulating tumor cells (in the case of leukaemia for example), cells obtained from a tumor bed, or cells obtained from a metastase.

An hormonotherapy is a therapy leading to apoptosis or Fas ligands or soluble/membrane bound TRAIL (TNF-related-apoptosis-inducing-ligand) or soluble/membrane bound TNF (tumor necrosis factor) alpha (TNFa). Cancers sensitive to a hormonotherapy are conventionally treated using a compound such as an antiaromatase for example.

Cancers sensitive to an immunotherapy are conventionally treated using a compound selected for example from IL-2 (Interleukin-2), IFN (Interferon) alpha (IFNα), and a vaccine.

Cancers sensitive to a specific kinase inhibitor-based therapy are conventionally treated using a compound selected for example from a tyrosine kinase inhibitor, a serine kinase inhibitor and a threonine kinase inhibitor.

Cancers sensitive to an antibody-based therapy, preferably to a monoclonal antibody-based therapy are conventionally treated using a specific antibody such as for example anti- CD20 (pan B-Cell antigen) or anti-Her2/Neu (Human Epidermal Growth Factor Receptor-2/NEU).

Preferably, the conventional treatment of cancer is a conventional chemotherapy or a conventional radiotherapy.

In the context of a conventional radiotherapy, the treatment may consist in exposing the subject to an irradiation selected for example from XR, gamma irradiations and/or UVC irradiations.

In the context of a conventional chemotherapy, the treatment may use a cytotoxic agent or cell death inducer (chemotherapeutic agent), in particular a genotoxic agent.

In a particular embodiment of the present invention, the chemotherapeutic agent is an agent selected for example from an anthracyclin, an antimitotic agent (spindle poison such as vincristine or vinblastine), a DNA intercalating agent, a taxane (such as docetaxel, larotaxel, cabazitaxel, paclitaxel (PG-paclitaxel and DHA-paclitaxel), ortataxel, tesetaxel, and taxoprexin), gemcitabine, etoposide, mitomycine C, an alkylating agent, a platin based component such as CDDP and OXP, and a TLR (Toll-like receptor)-3 ligand.

In a particular embodiment of the present invention, in particular when chemotherapy is administered to the subject before any surgical step, the chemotherapeutic agent is not a taxan, and preferably also not an antimitotic agent.

Particular anthracyclins may be selected, in the context of the present invention, from DX, daunorubicin, idarubicin and MTX.

In a particular embodiment of the present invention, the antibody used in an antibody-based therapy is a cytotoxic antibody.

A particular breast cancer is a breast cancer conventionally treated with anthracyclins, taxanes, Herceptin, anti-PARP (Poly (ADP-ribose) polymerase), anti-PI3K (Phosphoinositide 3-kinase), mTOR (mammalian Target of Rapamycin) inhibitors, navelbine, gemcitabine, antioestrogens, anti-aromatases, and/or a TLR-3 ligand, before or after a surgical step to remove breast tumor, preferably before such a surgical step.

A particular thyroid cancer is a thyroid cancer treated with radioactive iodine or tyrosine kinase inhibitors, preferably RET inhibitors.

A particular Hodgkin lymphoma is a Hodgkin lymphoma conventionally treated with CHOP [Cyclophosphamide, Hydroxydaunorubicin, Oncovin (vincristine), and Prednisone and/or Prednisolone] or anthracyclines.

A particular prostate cancer is a prostate cancer conventionally treated with taxanes and XR.

A particular colon cancer is a colon cancer conventionally treated with OXP and/or the combination of 5-fluorouracil (5 FU) and folinic acid.

A particular metastatic colon cancer is a metastatic colon cancer conventionally treated with 5 FU and OXP or irinothecan.

A particular rectal cancer is a rectal cancer conventionally treated with radiotherapy, preferably local radiotherapy, preferably together with CDDP and/or 5 FU.

A particular oesophagus cancer is an oesophagus cancer treated with CDDP, before or after a surgical step to remove the oesophagus tumor, preferably before such a surgical step, the administration of CDDP being preferably combined to the administration to the patient of a radiotherapy, preferably a local radiotherapy.

A particular kidney cancer is a kidney cancer conventionally treated with cytokines or antiangiogenic drugs (sorafenib).

A particular lung cancer is a lung cancer conventionally treated with XR and platine or Permetrexed (Alimta®).

A particular early stage NSCLC is an NSCLC conventionally treated with CDDP and/or etoposide, or with taxanes and avastin [anti-VEGF (Vascular endothelial growth factor) antibody].

A particular osteosarcoma and a preferred GIST are respectively an osteosarcoma and a GIST conventionally treated with anthracyclins, imatinib (Gleevec®) and/or sunitinib.

A particular melanoma is a melanoma conventionally treated with dacarbazine (DTIC); B-Raf inhibitors (PLX4032); sorafenib and/or temozolomide; electrochemotherapy; or isolated limb perfusion of TNFalpha, in particular of high doses of TNFalpha.

A particular neuroblastome is a neuroblastome conventionally treated with anthracyclines or alkylating agents, in particular in the context of autologous bone marrow transplantation or of stem cells transplantation.

A particular acute lymphoid leukemia is an acute lymphoid leukemia treated with anthracyclins, vinblastine and/or vincristine.

A particular multiple myeloma is a malignant hemopathy treated with anthracyclins, bortezomiv, revlimide, thalidomide and/or an alkylating agent, in particular in the context of autologous bone marrow or stem cell transplantation.

Conventional treatments of cancer, as described previously, in particular radio- and chemotherapy, are thought to mediate the direct elimination of tumour cells. Although different anti-tumour agents may kill tumor cells through an apparently homogenous apoptotic pathway, they differ in their ability to stimulate the subject's immune system. Indeed, there are circumstances in which anti-cancer therapy can induce a cellular death (immunogenic cell death) eliciting innate and cognate immune responses which in turn mediate part of the anti-tumour effect.

Inventors herein demonstrate that all cases of complete therapeutic success (cure) involve an immunological component.

As indicated previously, it is possible to distinguish between conventional treatments of cancer able to induce an immunogenic cell death, herein identified as "conventional immunogenic treatments", and conventional treatments of cancer which induce or tend to induce a non-immunogenic cell death, herein identified as "conventional non-immunogenic treatments".

As indicated previously, most of standard chemotherapies are known to induce a non-immunogenic apoptosis (Zitvogel et al., 2004; Steinman et al., 2004; Lake et al., 2006).

OXP and anthracyclines in particular induce immunogenic cell death, as do radiotherapy (ionizing radiations), while other agents such as CDDP and alkylating agents tend to induce a non-immunogenic cell death (Casares et al., 2005; Obeid et al., 2007), as do etoposide, 5-FU and mitomycin C.

A typical in vitro method used to assess the immunogenicity of a particular drug comprises the steps of:
(a) inducing the cell death or apoptosis of mammalian cells (for example cells from the CT26 or MCA205 mouse cell line), typically of mammalian cells capable of expressing calreticulin (CRT), by exposing said mammalian cells to a particular drug, for example 18 hours;
(b) inoculating (for example intradermally) the dying mammalian cells from step (a) in a particular area (for example a flank) of the mammal, typically a mouse, to induce an immune response in this area of the mammal;
(c) inoculating (for example intradermally) the minimal tumorigenic dose of syngeneic live tumor cells in a distinct area (for example the opposite flank) from the same mammal, for example 7 days after step (b); and (d) comparing the size of the tumor in the inoculated mammal with a control mammal also exposed to the minimal tumorigenic dose of syngeneic live tumor cells of step (c) [for example a mouse devoid of T lymphocyte], the stabilization or regression of the tumor in the inoculated mammal being indicative of the drug immunogenicity.

Inventors herein demonstrate that a subject having a tumor may however resist even to a conventional immunogenic treatment as previously identified and/or defined.

Herein provided is therefore an in vitro or ex vivo method of assessing the sensitivity of a subject having a tumor, as previously defined, to a treatment of cancer, in particular to a conventional immunogenic treatment, which method comprises a step of determining the ability of the subject and/or of the tumor to induce an anticancer immune response, the inability of at least one of the subject and of the tumor to induce an anticancer immune response being indicative of a resistance of the subject to the treatment of cancer.

Immune Cells

Inventors demonstrate the critical role of subsets of cells from the immune system, herein identified as "immune cells", which reveal the presence of an anticancer immune response from a subject having a tumor. Preferably, this subject has been exposed to a treatment of cancer, in particular to at least one conventional treatment of cancer.

In a particular embodiment, a method of assessing the sensitivity of a subject having a tumor to a treatment of cancer is herein provided, wherein the method comprises a step of detecting the presence of immune cells selected in particular from γδ T lymphocytes, dendritic cells and cytotoxic T lymphocytes, in a tumor sample of the subject.

In a preferred embodiment, the previously described method is applied on a subject who has not been exposed to a treatment of cancer. This method may further be applied to the same subject after said subject has been exposed to a treatment of cancer, in particular to a chemotherapeutic treatment of cancer, preferably to several cycles, for example two, three or four cycles of a complete chemotherapeutic treatment.

The method may further comprise a step of comparing the presence of immune cells in a tumor sample of the subject before and after exposition of the subject to a treatment of cancer as explained previously.

This method may be applied in vitro or ex vivo on a biological sample or biopsy from the subject, in particular on a tumor sample or biopsy, on a biopsy of cells from the tumor bed, on cytospins, on cells from a metastase, or on circulating tumor cells.

The presence of immune cells in the tumor of a subject is indicative of the presence of an anticancer immune response in the subject who has been exposed to a treatment of cancer and reveals the sensitivity of the subject to the treatment of cancer (responder phenotype).

The absence of immune cells in the tumor of a subject is indicative of the absence of an anticancer immune response in the subject who has been exposed to a treatment of cancer and reveals a resistance of the subject to the treatment of cancer (non responder phenotype).

The γδ T lymphocytes, the presence of which may be checked in the previously described method, are preferably selected from Vγ4$^+$ γδ T lymphocytes (mouse), in particular activated Vγ4$^+$ γδ T lymphocytes; Vδ2 (or Vδ1 in humans) T lymphocytes; Vγ6$^+$ γδ T lymphocytes, in particular activated Vγ6$^+$ γδ T lymphocytes; IL-17 producing γδ T lymphocytes (also herein called "γδ T17 cells"), in particular cells expressing RORγt (RAR-related orphan receptor), AHR (aryl hydrocarbone receptor), IL-23R, IL-17A and/or IL-22; γδ T lymphocytes expressing the IL-1 receptor (IL-1R or IL-1R1); and any combination of the previously mentioned γδ T lymphocytes such as, in particular IL-17 producing—Vγ4$^+$ and Vγ6$^+$ γδ T lymphocytes, preferably expressing the IL-1R.

The previously mentioned γδ T lymphocytes populations identify populations of mammalian cells. Human γδ T lymphocytes have Vδ2 (circulating) T lymphocytes but no Vd2 (mucosal) T lymphocytes, contrary to mouse γδ T lymphocytes. Both populations of Vδ2 and Vd2 T lymphocytes are however able to differentiate into VγdT17 cells.

It is to note that the Vγδ T lymphocytes, in particular those present in tumor beds, have the following phenotype: Ki67$^+$, GzB$^+$, CD69$^+$ and IL-17$^+$, when they are activated.

The dendritic cells, the presence of which may be checked in the previously described method, are preferably selected from myeloid cells (such as monocytic cells and macrophages) expressing langerin, MHC (major histocompatibility complex) class II, CCR2 (chemokine (C-C motif) receptor 2), CX3CR1 and/or Gr1 molecules in mice; myeloid cells expressing CD14, CD16, HLA dR (human leukocyte antigen disease resistance) molecule, langerin, CCR2 and/or CX3CR1 in humans; dendritic cells expressing CD11c, MHC class II molecules, and/or CCR7 molecules; and IL-1β producing dendritic cells.

The cytotoxic T lymphocytes, the presence of which may be checked in the previously described method, are preferably selected from CD3+, CD4+ and/or CD8+ T lymphocytes, FOXP3 (forkhead box P3) T lymphocytes, Granzyme B/TIA (Tcell-restricted intracellular antigen) T lymphocytes, and Tc1 cells (IFN-γ producing CD8+ T lymphocytes).

Other immune cells, the presence of which may be checked in the previously described method, are cells expressing a CRT receptor.

Such immune cells may be selected from cells expressing at least one of the following proteins: LRP1 (Low density lipoprotein receptor-related protein 1, CD91), Ca$^{++}$-binding proteins such as SCARF1 and SCARF2, MSR1 (Macrophage scavenger receptor 1), SRA, CD59 (protectin), CD207 (langerin), and THSD1 (thrombospondin).

The detection step of the previously identified immune cells can be easily performed according to methods known by the man of the art such as immunochemistry, immunophenotyping, flow cytometry, Elispots assays (Panaretakis T. et al., 2009), classical tetramer stainings (Ghiringhelli F, et al., 2009), intracellular cytokine stainings, (Conforti R et al, 2010).

In a particular embodiment of the present invention, the step of determining the presence of an anticancer immune response may consist in detecting and/or dosing, in a biological sample of the patient, for example in a blood or serum sample of the patient, the presence (or normal expression) of a particular cytokine, a particular chemokine, and/or of particular antibody, the absence or abnormal expression (in particular an insufficient amount), when compared to a standard expression (for example level of expression), of the particular cytokine, of the particular chemokine and/or of the particular antibody being indicative of an absent or insufficient anticancer immune response.

The cytokine the presence of which is to be determined according to the previously described method may be selected from IL-1b, IL-7, IL-10, IL-12a, IL-12b, IL-15, IL-17, IL-21, IL-23, IL-27, IL-33, TNFa, LTbeta (lymphotoxin beta), IFNalpha, beta, lambda, gamma, and the following cytokine receptors [ST2/IL1r11, IL-1R1, IL-7r, IL-15Ra, IL-21R, IL-23R, LtbR, AHR, Flt3 (fms-like tyrosine kinase receptor-3, CD135)] and the following transcription factors (RORc, RORgt, FOXP3, Ikaros, Id2, PU-1).

The chemokine the presence of which is to be determined according to the previously described method may be selected from CCL2 (Chemokine (C-C motif) ligand), CCL20/MIP3A, CCL5/RANTES, CCL7, CCL25, CXCL1, CXCL2, CXCL9/ITAC, CXCL10/IP10, CXCL12/SDF1, CXCL13, CXCL16/Bonzo, CX3CL1/Fractalkine, and their receptors (CXCR1, CXCR2, CXCR4, CXCR5, CXCR6, CCR2, CCR4, CCR5, CCR7, CX3CR1).

The antibody (Ab) the presence of which is to be determined according to the previously described method may be selected from anti-CRT Ab, anti-NY-ESO1 Ab, anti-LAGE1 Ab, anti-MICA/B Ab, anti-disulfide isomerase ERp5Ab, anti-PARP1 Ab, anti-ZNF707 (zinc finger protein) Ab in combination with PTMA (prothymosin, alpha), anti-CEP78 (centrosomal protein) Ab, anti-ODF2 (outer dense fiber of sperm tail 2) Ab, anti-SDCCAG1 (serologically defined colon cancer antigen 1) Ab, anti-endothelin 1 (ET-1) ligand Ab, anti-endothelin B receptor ($ET_BR$) Ab and anti-Rgs5 (regulator of G protein signalling 5) Ab.

Immunogenic Cell Death-Associated Molecules Found in the Tumor

The step of determining the ability of the tumor to induce an anticancer immune response consists in verifying, in the tumor cells (in particular in dying tumor cells, for example cells which have been exposed to a treatment of cancer), the presence of specific features herein disclosed and identified as "immunogenic cell death-associated molecules or signals" or "danger signals". Inventors herein demonstrate that stressed and dying tumor cells emit a particular pattern of "danger signals". These immune cell death-associated molecules are either exposed on the surface of dying cells or secreted into the microenvironment. Thus, the combined action of 'find-me' signals (for the attraction of phagocytes) and 'eat-me' signals (for corps engulfment) together with the release of hidden molecules (which often signal danger and are usually secluded within live cells), influence the switch between silent corpse removal and inflammatory reactions that stimulate the cellular immune response.

Inventors discovered that some of said immunogenic cell death-associated molecules are inherent to the tumor, i.e., independent from the subject having the tumor or from the treatment the subject may have been exposed to. Others only appear in or around the tumor (for example in a tumor bed) after an exposition of the subject having the tumor to a conventional treatment of cancer.

Inventors have discovered, in the present invention, that if the tumor cells of the subject do not correctly or normally express a functional immunogenic cell death-associated molecule, such as one of the particular proteins identified below, in particular do not secrete such a molecule or do not expose such a molecule at their surface (or otherwise secrete or expose such a molecule at an abnormal level compared to a standard level), an additional treatment, herein identified as "compensatory immunogenic treatment of cancer", should be administered to said patient, preferably in addition to a conventional treatment of cancer, to favour a reaction from the immune system against said tumour cells.

The exposure or secretion can be observed or determined before or after exposition of the subject to a conventional therapy as described previously, preferably after such an exposition, even more preferably before and after such an exposition.

In a particular embodiment of the present invention, the method of determining the ability of a tumor to induce an anticancer immune response comprises a step of comparing the expression by tumor cells of functional immunogenic cell death-associated molecules before and after exposition of said tumor cells to a treatment of cancer.

An absent or abnormal (for example insufficient) level of expression of an immunogenic cell death-associated molecule by the tumor cell in response to a cancer treatment, in particular to a conventional one, indicates that the cell will not be, completely or partially, destroyed or eradicated by said cancer treatment.

In EP2084531, inventors have shown that the pre-apoptotic translocation of intracellular CRT (endo-CRT) to the plasma membrane surface (ecto-CRT) is a key feature of "immunogenic cell death". They demonstrated that when CRT is exposed on the surface of dying cells, it promotes their destruction by phagocytes such as dendritic cells. Phagocytes then interact with the immune system which is, in turn, responsible for the immune response. Inventors further demonstrated (i) that this effect is amplified when CRT is present in an increased amount on the surface of dying cells and (ii) that CRT is present in an increased amount on the surface of most tumour cells of a subject who has been exposed to a conventional treatment of cancer, in particular a cell death inducer (apoptosis inducer).

Inventors also showed that the proteins whose expression level and post-transcriptional modification regulate CRT exposure comprise in particular:
- at the level of ceramide metabolism: ceramide synthase, dihydroceramide desaturase, 3-ketosphingane reductase, serine palmitoyltransferase, sphingomyelin synthase, shingomyelinase, ceramidase, ceramide synthase, sphingosine kinase, sphingosine-1-phosphate phosphatase;
- at the level of Bcl-2 proteins: Bax, Bak, Bok, Bcl-2, Bcl-XL, Mcl-1 as well as all the other multidomain or BH3-only proteins from the Bcl-2 family
- at the level of caspase-8 (CASP 8) activation and substrates: FADD (Fas-Associated protein with Death Domain), FLIP (FLICE-inhibitory protein), RIP (Receptor-interacting protein), TRADD (Tumor necrosis factor receptor type 1-associated DEATH domain), BAP31 (B-cell receptor-associated protein 31);
- at the level of the endoplasmic reticulum (ER) stress response: eIF2alpha (eIF2A), phosphorylated eIF2alpha, CRT, ERp57, GCN2, HRI, PERK, PKR, PP1, GADD34, IRE1, PERK, HMGB1 and ATF6, BiP;
- at the level of the CRT translocation machinery: CRT, ERp57, KARS (lysyl-tRNA synthetase, LysRS), and KDEL receptor (Lys-Asp-Glu-Leu (SEQ ID NO: 530) endoplasmic reticulum protein retention receptor).

In the context of the present invention, the step of determining the ability of the tumor to induce an anticancer immune response may for example consist in verifying the correct expression, by tumour cells, of a protein allowing or enhancing CRT exposure at the surface of the cells (herein considered as an immunogenic cell death-associated molecule or immunogenic cell death marker). Such a protein may be anyone of the previously described proteins.

For example, such a protein may be selected in particular from CRT, CCL3 (MIP-1-alpha) (SEQ ID NO: 456); CCR1 (MIP1 alpha receptor, RANTES-R) (SEQ ID NO: 457); CCR2 (MCP-1 receptor) (SEQ ID NO: 458); IL-8 (C-X-C motif chemokine 8) (SEQ ID NO: 459); CXCR1 (IL-8 Receptor type 1) (SEQ ID NO: 460); CXCR2 (IL-8 Receptor type 2) (SEQ ID NO: 461); TNFRSF10A or TRAIL-receptor 1 (SEQ ID NO: 462), TNFRSF10B or TRAIL-receptor 2 (SEQ ID NO: 463), TNFRSF10C or TRAIL-receptor 3 (SEQ ID NO: 464), TNFRSF10D or TRAIL-receptor 4 (SEQ ID NO: 465D), iNOS (Inducible NO synthase) (SEQ ID NO: 466); SOD2 (Superoxide dismutase 2) mitochondriale (SEQ ID NO: 467); E2AK3 (Eukaryotic translation initiation factor 2-alpha kinase 3, PERK) (SEQ ID NO: 468), in particular phosphorylated PERK; E2AK2 (EIF2AK2, Interferon-induced double-stranded RNA-activated protein kinase, PKR) (SEQ ID NO: 469); PP1 (Serine/threonine-protein phosphatases), in particular PP-1A (SEQ ID NO: 470), PP-1B (PPP1CB) (SEQ ID NO: 471) or PP-1G (PPP1CC) (SEQ ID NO: 472); PR15A (Protein phosphatase 1 regulatory subunit 15A, GADD34) (SEQ ID NO: 473); eIF-2A, in particular phosphorylated eIF-2A (SEQ ID NO: 474); SERCA (Sarcoplasmic/endoplasmic reticulum calcium ATPases), in particular SERCA1 (SEQ ID NO: 475), SERCA2 (SEQ ID NO: 476), SERCA3 (SEQ ID NO: 477); MAP kinase 8 (MAPK8 or JNK1) (SEQ ID NO: 478); MAP kinase 9 (MAPK9 or JNK2) (SEQ ID NO: 479); IKBKA (IKK-alpha, IKKA, NFKBIKA, TCF-16) (SEQ ID NO: 480); IKBKB (IKK-beta, IKK2, NFKBIKB) (SEQ ID NO: 481); NEMO (IKBKG, IKK-gamma, IKKAP1) (SEQ ID NO: 482); CASP-1 (IL-1BC, ICE), in particular activated CASP-1 (SEQ ID NO: 483); CASP-8 (MACH, FLICE) (SEQ ID NO: 484), in particular activated CASP-8; FADD (SEQ ID NO: 485); BAP31 (SEQ ID NO: 486) in particular cleaved BAP31; BAX (Bcl2-L-4) (SEQ ID NO: 487); BAK (Bcl2-L-7) (SEQ ID NO: 488); Bcl-2 (SEQ ID NO: 489); Bcl2-L-1 (Bcl-X) (SEQ ID NO: 490); ERp57 (protein disulfide-isomerase A3, PDIA3, ERp60) (SEQ ID NO: 491); and LysRS (SEQ ID NO: 492).

The step of determining the ability of the tumor to induce an anticancer immune response may also for example consist in verifying the correct expression (as defined previously), by tumour cells, of a protein expressed during the ER stress response and/or during the macroautophagic response of the subject's immune system (identified by inventors as involved in the immunogenic tumor cell death and herein considered as an immunogenic cell death-associated molecules).

Such a protein may be selected for example from AMBRA1 (Activating Molecule in Beclin-1-Regulated Autophagy), AMPK (5' adenosine monophosphate-activated protein kinase), ATG1, ATG5, ATG7, ATG10, ATG12, ATG14L (BARKOR), BCLN1 (Beclin 1), BIF1, CaMKK¾ (calcium/calmodulin-dependent protein kinase kinase), DAPK (death-associated protein kinase), DDIT3 (DNA damage inducible transcript 3) (CHOP, GADD153), DRAM (damage-regulated autophagy modulator), FIP200 (RB1CC1), FoxO3 (forkhead box 0 transcription factor), GATE-16 (Golgi-associated ATPase enhancer of 16 kDa), HDAC6 (histone deacetylase 6), HSPA5 (BiP (Binding immunoglobulin protein), GFP78, GP96), XBP1 (X-box binding protein 1), DNAJC3 (DnaJ homolog subfamily C member 3) (p581PK), DNAJB9, DNAJB11, DNAJC10 (DNA sequence corresponding to SEQ ID NO: 527), EDEM1 (ER degradation-enhancing alpha-mannosidase-like 1), EDEM2, EDEM3, FIP200, GABARAP (gamma-aminobutyric acid receptor-associated protein), LAMP-2 (lysosome-associated membrane protein type 2), LC3 (microtubule-associated protein 1 light chain 3) and its isoforms LC3A, LC3B and LC3C, the lipidated form of LC3 (LC3-II), mTOR, SERP1 (Stress-associated endoplasmic reticulum protein 1), SERP2, p62 (sequestosome 1/SQSTM1), PDIA6, PP1R15A (GADD34), Raptor, Rubicon (RUN domain and cysteine-rich domain containing, Beclin 1-interacting) TSC1 (tuberous sclerosis complex 1) and TSC2 (tuberous sclerosis complex 2).

In a particular embodiment of the present invention, the presence, in a tumor sample of the subject, of an abnormal expression of a gene selected from CCR1, EIF2AK2, DNAJC10, PDIA3, EIF2A, PPP1CB, IKBKB, PPP1CC, and BAX, determines the inability of the subject to induce an anticancer immune response.

The expression is correct if the expressed protein is active or functional, i.e., in the context of the present invention, if the expressed protein is able to directly or indirectly induce a response from the immune system directed against the tumour cell.

In a particular method, the expression abnormality is a downregulation of the expression of CCR1, a downregulation of the expression of EIF2AK2, an upregulation of the expression of DNAJC10, and/or an upregulation of the expression of PDIA3.

In another particular method, the expression abnormality is a downregulation of the expression of CCR1, a downregulation of the expression of EIF2AK2, and an upregulation of the expression of DNAJC10.

In a further particular method, the expression abnormality is a downregulation of the expression of CCR1, a downregulation of the expression of EIF2AK2, and an upregulation of the expression of PDIA3.

Methods usable by the man of the art to detect or quantify the previously mentioned proteins are well-known from the skilled man of the art and further identified below in the description.

When the tumour cells do not express or abnormally express the previously mentioned proteins, inventors herein indicates that a "compensatory immunogenic treatment of cancer" has to be applied to the subject having a tumor to induce a reaction of the immune system directed against said tumor.

The present disclosure further relates to the abnormal expression of a gene which is specific to tumor cells.

The step of determining the ability of the tumor to induce an anticancer immune response may also consist in detecting the presence of an altered mutated nucleic acid, of an abnormal expression of the nucleic acid, or of an abnormal expression or activity of the protein encoded by the nucleic acid in a biological sample from the tumor's subject (as defined previously), the presence of said altered nucleic acid, abnormal expression of the nucleic acid, or abnormal expression or activity of the protein encoded by said nucleic acid being indicative of the inability for the tumor to induce an anticancer immune response, in particular when the subject having the tumor has been previously exposed to a treatment of cancer.

This detection step may indeed be performed before or after the administration to the subject having the tumor of at least part of a treatment of cancer, typically of at least part of a conventional treatment of cancer as previously explained. The detection step is preferably performed after such an administration, for example after one or two cycles of a complete treatment protocol.

The nucleic acid, mentioned in the previously described method, the alteration of which, abnormal expression of which, or the abnormal expression of the corresponding endogenous protein (protein encoded by said nucleic acid), should be detected, may be a gene encoding a protein selected from Eomes (SEQ ID NO: 493), IFNg (SEQ ID NO: 494), Tbx21 (Tbet) (SEQ ID NO: 495), IL-1R1 (SEQ ID NO: 496), FOXP3 (SEQ ID NO: 497), Ltb (SEQ ID NO: 498), LtbR (SEQ ID NO: 499), CXCL12 (SEQ ID NO: 500), CXCL13 (SEQ ID NO: 522), IL-33 (SEQ ID NO: 501), IL1RL1 (ST2) (SEQ ID NO: 502), IL-7r (SEQ ID NO: 503), IL-7 (SEQ ID NO: 504), Ccl5 (SEQ ID NO: 505), IL-21 (SEQ ID NO: 506), CXCL10 (IP-10) (SEQ ID NO: 507), CXCL2 (SEQ ID NO: 508), CXCL9 (Mig) (SEQ ID NO: 509), TNF-alpha (TNF-a) (SEQ ID NO: 510), IL-15 (SEQ ID NO: 511), AHR (SEQ ID NO: 1), IL-15ra (SEQ ID NO: 512), IL-1b (SEQ ID NO: 513), CXCL16 (SEQ ID NO: 514), CXCR6 (SEQ ID NO: 523), IL-10 (SEQ ID NO: 515), IL-27 (SEQ ID NO: 516), Ccl7 (SEQ ID NO: 517), IL-23r (SEQ ID NO: 518), CX3CL1 (SEQ ID NO: 519), CCL2 (SEQ ID NO: 520), IL-8 (SEQ ID NO: 521), CXCL11 (ITAC) (SEQ ID NO: 524), CXCR1 (SEQ ID NO: 525), CXCR2 (SEQ ID NO: 526), CCR1 (SEQ ID NO: 457), EIF2AK2 (SEQ ID NO: 469), DNAJC10 (SEQ ID NO: 527), PDIA3 (SEQ ID NO: 491), EIF2A (SEQ ID NO: 474), PPP1CB (SEQ ID NO: 471), IKBKB (SEQ ID NO: 481), PPP1CC (SEQ ID NO: 472), and BAX (SEQ ID NO: 487).

In a particular embodiment of the present invention, the step of determining the ability of the tumor to induce an anticancer immune response may consist in determining alteration in a gene locus or in the expression of the protein encoded by said gene, in a biological sample of the patient, the presence of such an alteration being indicative of the inability of the tumor to induce an anticancer immune response.

In a particular embodiment, a method of determining the ability of a tumor to induce an anticancer immune response may comprise the following steps of (a) obtaining from the subject a test sample of tumoral DNA, cDNA or RNA, (b) contacting the test sample with at least one nucleic acid probe, wherein said nucleic acid is complementary to and specifically hybridises with a targeted altered nucleic acid sequence (one of the previously identified sequence) preferably comprising at least one point mutation, in particular a single nucleotide polymorphism (SNP), to form a hybridization sample, (c) maintaining the hybridization sample under conditions sufficient for the specific hybridization of the targeted nucleic acid sequence with the nucleic acid probe to occur, and (d) detecting whether there is specific hybridization of the altered targeted nucleic acid sequence with the nucleic acid probe.

Particular techniques the aim of which is to determine the abnormal (in particular low or absent) expression of a particular nucleic acid such as those described previously, or the abnormal expression of the corresponding endogenous protein (protein encoded by said nucleic acid) are detailed later in the description.

In a particular embodiment, if the tumor of a subject is not able to induce an anticancer immune response, the subject will be identified as resistant to conventional treatments of cancer.

Inventors herein demonstrate that a "compensatory immunogenic treatment of cancer" as disclosed in the present description should be administered, preferably in addition to a conventional treatment of cancer, to such resistant subjects having a tumor which is not able to induce an efficient anticancer immune response, in order to allow such a response.

Immunogenic Cell Death-Associated Products Found in the Subject

Inventors herein demonstrate that the immunogenic cell death is also dependant from products, herein identified as "immunogenic cell death-associated products or signals", specific to the mammal, in particular to the human, i.e., independent from the presence of a tumor in the mammal subject, and independent from any treatment a mammal subject having a tumor may have been exposed to.

The step of determining the ability of the subject to induce an anticancer immune response may consist in detecting, using one of the previously identified methods (well known by the man skilled in the art), the presence of a mutated nucleic acid, of an abnormal expression of the nucleic acid, or of an abnormal expression or activity of the protein encoded by the nucleic acid in a biological sample (as defined previously) from the subject, the presence of said mutated nucleic acid, abnormal expression of the nucleic acid, or abnormal expression or activity of the protein encoded by said nucleic acid, being indicative of the inability for the subject to induce an anticancer immune response.

In a particular embodiment, if the subject is not able to induce an anticancer immune response, the subject will be identified as resistant or non-responder to conventional treatments of cancer as defined previously.

In a particular embodiment, a method of determining the ability of a subject to induce an anticancer immune response may comprise the following steps of (a) obtaining from the subject a test sample of DNA, preferably of genomic DNA, (b) contacting the test sample with at least one nucleic acid probe, wherein said nucleic acid is complementary to and specifically hybridises with a targeted mutated nucleic acid sequence (one of the below identified sequences) comprising a point mutation, preferably a single nucleotide polymorphism (SNP), to form a hybridization sample, (c) maintaining the hybridization sample under conditions sufficient for the specific hybridization of the targeted nucleic acid sequence with the nucleic acid probe to occur, and (d) detecting whether there is specific hybridization of the mutated targeted nucleic acid sequence with the nucleic acid probe.

If the subject has a tumor, the previously described detection step may be performed before and/or after any conventional treatment of cancer.

In a preferred embodiment, the step of determining the ability of a subject to induce an anticancer immune response may consist in detecting an abnormal nucleic acid sequence in a biological sample from the subject, the detection of such an abnormal nucleic acid sequence determining the inability of the subject to induce an anticancer immune response.

The method may in particular consist in verifying the presence, in the genome of the subject, of a mutated nucleic acid sequence leading to the abnormal expression of a gene involved in the "anti-cancer immune response", the presence of such a mutated nucleic acid sequence determining the inability of the subject to induce an anticancer immune response. These genes are herein identified under the term "immune genes".

The nucleic acid, mentioned in the previously described methods, is typically located in an immune gene as defined previously and identified below.

In the context of the present invention, immune genes may be selected from anyone of the genes identified below in Table 1. Table 1 further identifies, for each immune gene, SNP(s) associated to a non-responder status of the subject (in other words, to the inability of the subject to induce an anticancer immune response).

In the below table the expression "A/G" for example, means that a guanine has been substituted to an adenosine.

TABLE 1

| Gene | Alteration/SNP reference | Polymorphism | Sequence reference | Coding status |
|---|---|---|---|---|
| NLRP4 | rs12462372 | A/G | SEQ ID NO: 141 | NONSYN |
| DDX58 | rs12006123 | A/G | SEQ ID NO: 136 | 3UTR |
| CX3CR1 | rs3732379 | C/T | SEQ ID NO: 313 | NONSYN |
| MTHFR | rs1801131 | A/C | SEQ ID NO: 192 | NONSYN |
| FAT2 | rs2053028 | A/C/G/T | SEQ ID NO: 216 | NONSYN |
| IL1RL1 | rs1041973 | A/C | SEQ ID NO: 82 | NONSYN |
| HLA-DMB | rs1042337 | C/T | SEQ ID NO: 83 | SYNON |
| LENG9 | rs10423424 | C/G | SEQ ID NO: 84 | NONSYN |
| TP53 | rs1042522 | C/G | SEQ ID NO: 85 | NONSYN |
| UGT1A8 | rs1042597 | C/G/T | SEQ ID NO: 86 | NONSYN |
| NLRP2 | rs1043673 | A/C | SEQ ID NO: 87 | NONSYN |
| TAPBPL | rs1045546 | A/G | SEQ ID NO: 88 | NONSYN |
| BAT2 | rs1046080 | A/C | SEQ ID NO: 89 | NONSYN |
| MAGEA4 | rs1047246 | C/G | SEQ ID NO: 90 | 5UTR |
| CABYR | rs1049683 | A/C | SEQ ID NO: 91 | NONSYN |
| PHC1 | rs1049925 | C/T | SEQ ID NO: 92 | NONSYN |
| ZNF615 | rs10500311 | A/G | SEQ ID NO: 93 | NONSYN |
| Klkbl4 | rs1052276 | A/C/G/T | SEQ ID NO: 94 | NONSYN |
| SH3RF2 | rs1056149 | C/G | SEQ ID NO: 95 | NONSYN |
| ZNF83 | rs1056185 | A/C/G/T | SEQ ID NO: 96 | NONSYN |
| LRRC23 | rs1057077 | A/T | SEQ ID NO: 97 | NONSYN |
| ATF6 | rs1058405 | A/G/T | SEQ ID NO: 98 | NONSYN |
| IRF7 | rs1061501 | A/G | SEQ ID NO: 99 | SYNON |
| TNFRSF1B | rs1061622 | G/T | SEQ ID NO: 100 | NONSYN |
| MPHOSPH1 | rs1062465 | A/T | SEQ ID NO: 101 | NONSYN |
| ITGAL | rs1064524 | C/T | SEQ ID NO: 102 | NONSYN |
| BRDT | rs10747493 | C/T | SEQ ID NO: 103 | NONSYN |
| ECE1 | rs1076669 | C/T | SEQ ID NO: 104 | NONSYN |
| DDX58 | rs10813831 | A/G | SEQ ID NO: 105 | NONSYN |
| ARMC3 | rs10828395 | A/G | SEQ ID NO: 106 | NONSYN |
| PZP | rs10842971 | A/T | SEQ ID NO: 107 | NONSYN |
| ZNF818 | rs10853858 | A/G | SEQ ID NO: 108 | NONSYN |
| TIGD6 | rs10875553 | A/C/G/T | SEQ ID NO: 109 | NONSYN |
| CTSS | rs2230061 | C/T | SEQ ID NO: 110 | NONSYN |
| IFIH1 | rs10930046 | C/T | SEQ ID NO: 111 | NONSYN |
| LARS | rs10988 | C/T | SEQ ID NO: 112 | NONSYN |
| FAT2 | rs1105168 | A/G | SEQ ID NO: 113 | NONSYN |
| CEP290 | rs11104738 | C/T | SEQ ID NO: 114 | NONSYN |
| FBXO7 | rs11107 | C/T | SEQ ID NO: 115 | NONSYN |
| GNLY | rs11127 | C/T | SEQ ID NO: 116 | NONSYN |
| CCDC110 | rs11132306 | A/G | SEQ ID NO: 117 | NONSYN |
| IL23R | rs11209026 | A/G | SEQ ID NO: 118 | NONSYN |
| HSPB9 | rs1122326 | A/C | SEQ ID NO: 119 | NONSYN |
| CD86 | rs1129055 | A/G | SEQ ID NO: 120 | NONSYN |
| GAK | rs1134921 | A/G | SEQ ID NO: 121 | NONSYN |
| SP110 | rs1135791 | C/T | SEQ ID NO: 122 | NONSYN |
| LEPR | rs1137101 | A/G | SEQ ID NO: 123 | NONSYN |
| GSTP1 | rs1138272 | C/T | SEQ ID NO: 124 | NONSYN |
| IRAK3 | rs1152888 | A/G | SEQ ID NO: 125 | NONSYN |
| BRDT | rs1156281 | A/C | SEQ ID NO: 126 | NONSYN |
| EGF | rs11568943 | A/G | SEQ ID NO: 127 | NONSYN |
| EGF | rs11569017 | A/T | SEQ ID NO: 128 | NONSYN |
| MAEL | rs11578336 | G/T | SEQ ID NO: 129 | NONSYN |
| FAM196A | rs11594560 | A/C/G/T | SEQ ID NO: 130 | NONSYN |
| ERCC1 | rs11615 | C/T | SEQ ID NO: 131 | SYNON |
| SIGLEC12 | rs11668530 | A/C/G/T | SEQ ID NO: 132 | NONSYN |
| FCRLA | rs11746 | A/G | SEQ ID NO: 133 | NONSYN |
| NUF2 | rs11802875 | C/T | SEQ ID NO: 134 | NONSYN |
| CASC5 | rs11858113 | C/T | SEQ ID NO: 135 | NONSYN |
| TNXB | rs1009382 | A/C/G/T | SEQ ID NO: 78 | NONSYN |
| PLAC8L1 | rs12187913 | A/T | SEQ ID NO: 137 | NONSYN |
| ZNF816A | rs12459008 | A/T | SEQ ID NO: 138 | NONSYN |
| ZNF665 | rs12460170 | A/G | SEQ ID NO: 139 | NONSYN |
| NLRP11 | rs12461110 | A/C/G/T | SEQ ID NO: 140 | NONSYN |
| SLCO6A1 | rs10055840 | C/G | SEQ ID NO: 77 | NONSYN |
| UGT1A5 | rs12475068 | C/G | SEQ ID NO: 142 | NONSYN |
| IFIH1 | rs12479043 | C/G | SEQ ID NO: 143 | SYNON |
| C5orf20 | rs12520809 | C/T | SEQ ID NO: 144 | NONSYN |
| DDX58 | rs12555727 | A/G | SEQ ID NO: 145 | 3UTR |
| MPHOSPH1 | rs12572012 | A/T | SEQ ID NO: 146 | NONSYN |
| C6orf15 | rs1265053 | C/G | SEQ ID NO: 147 | NONSYN |
| LY75 | rs12692566 | A/C | SEQ ID NO: 148 | NONSYN |
| IL1RL1 | rs12712142 | A/C | SEQ ID NO: 149 | 3UTR |
| GDF3 | rs12819884 | C/T | SEQ ID NO: 150 | NONSYN |
| CCHCR1 | rs130076 | C/T | SEQ ID NO: 151 | NONSYN |
| CCDC36 | rs13068038 | A/C | SEQ ID NO: 152 | NONSYN |
| SLCO6A1 | rs13190449 | A/G | SEQ ID NO: 153 | NONSYN |

TABLE 1-continued

| Gene | Alteration/SNP reference | Polymorphism | Sequence reference | Coding status |
|---|---|---|---|---|
| RNF216 | rs13236790 | C/T | SEQ ID NO: 154 | NONSYN |
| TNFRSF10B | rs13265018 | A/C/G | SEQ ID NO: 155 | NONSYN |
| ZNF480 | rs13343641 | C/T | SEQ ID NO: 156 | NONSYN |
| HORMAD1 | rs1336900 | A/G | SEQ ID NO: 157 | NONSYN |
| IL1RL1 | rs13431828 | C/T | SEQ ID NO: 158 | 5UTR |
| LY75 | rs1397706 | A/G | SEQ ID NO: 159 | NONSYN |
| IL1RL1 | rs1420101 | A/G | SEQ ID NO: 160 | intron |
| RELL2 | rs14251 | A/C | SEQ ID NO: 161 | NONSYN |
| FAT2 | rs1432862 | A/G | SEQ ID NO: 162 | NONSYN |
| IL7R | rs1494555 | C/T | SEQ ID NO: 163 | NONSYN |
| IL7R | rs1494558 | A/G | SEQ ID NO: 164 | NONSYN |
| A2ML1 | rs1558526 | A/G | SEQ ID NO: 165 | NONSYN |
| GP6 | rs1613662 | A/G | SEQ ID NO: 166 | NONSYN |
| C6orf205 | rs1634730 | C/T | SEQ ID NO: 167 | NONSYN |
| PCDH12 | rs164075 | A/C/G/T | SEQ ID NO: 168 | NONSYN |
| PCDH12 | rs164515 | A/C/G/T | SEQ ID NO: 169 | NONSYN |
| GP6 | rs1654416 | A/C/G/T | SEQ ID NO: 170 | NONSYN |
| SP100 | rs12724 | A/G | SEQ ID NO: 171 | NONSYN |
| CD180 | rs16875312 | C/G | SEQ ID NO: 172 | NONSYN |
| NME1-NME2 | rs16949649 | C/T | SEQ ID NO: 173 | flanking_5UTR |
| GSTP1 | rs1695 | A/G | SEQ ID NO: 174 | NONSYN |
| CASC5 | rs16970911 | A/G | SEQ ID NO: 175 | NONSYN |
| ZNF615 | rs16983353 | C/T | SEQ ID NO: 176 | NONSYN |
| FCAR | rs16986050 | A/G | SEQ ID NO: 177 | NONSYN |
| PTPRH | rs16986309 | A/C/G/T | SEQ ID NO: 178 | NONSYN |
| TMCO6 | rs17208187 | C/G | SEQ ID NO: 179 | NONSYN |
| SP100 | rs17275036 | A/G | SEQ ID NO: 180 | NONSYN |
| MPHOSPH1 | rs17484219 | G/T | SEQ ID NO: 181 | NONSYN |
| P2RX7 | rs17525809 | C/T | SEQ ID NO: 182 | NONSYN |
| MMP9 | rs17576 | A/G | SEQ ID NO: 183 | NONSYN |
| PSMB9 | rs17587 | A/G | SEQ ID NO: 184 | NONSYN |
| CASC5 | rs17747633 | A/G | SEQ ID NO: 185 | NONSYN |
| SPINK5 | rs17775319 | A/G | SEQ ID NO: 186 | NONSYN |
| LY75 | rs17827158 | C/T | SEQ ID NO: 187 | NONSYN |
| UGT1A8 | rs17863762 | A/G | SEQ ID NO: 188 | NONSYN |
| TLR7 | rs179008 | A/C/T | SEQ ID NO: 189 | NONSYN |
| ICAM1 | rs1799969 | A/G | SEQ ID NO: 190 | NONSYN |
| IL6 | rs1800795 | C/G | SEQ ID NO: 191 | flanking_5UTR |
| C5orf20 | rs1031844 | G/T | SEQ ID NO: 80 | NONSYN |
| ESR1 | rs1801132 | C/G | SEQ ID NO: 193 | SYNON |
| MTHFR | rs1801133 | C/T | SEQ ID NO: 194 | NONSYN |
| ERBB2 | rs1136201 | A/G | SEQ ID NO: 195 | NONSYN |
| IL4R | rs1801275 | A/G | SEQ ID NO: 196 | NONSYN |
| CD180 | rs1803440 | C/G | SEQ ID NO: 197 | 3UTR |
| IL4R | rs1805011 | A/C | SEQ ID NO: 198 | NONSYN |
| IL4R | rs1805015 | C/T | SEQ ID NO: 199 | NONSYN |
| IL4R | rs1805016 | G/T | SEQ ID NO: 200 | NONSYN |
| TNXB | rs185819 | A/C/G/T | SEQ ID NO: 201 | NONSYN |
| A2ML1 | rs1860967 | C/T | SEQ ID NO: 202 | NONSYN |
| MFGE8 | rs1878326 | A/C/G/T | SEQ ID NO: 203 | NONSYN |
| IL23R | rs1884444 | G/T | SEQ ID NO: 204 | NONSYN |
| MPHOSPH1 | rs1886996 | C/T | SEQ ID NO: 205 | NONSYN |
| MPHOSPH1 | rs1886997 | A/G | SEQ ID NO: 206 | NONSYN |
| ICOS | rs1978595 | C/T | SEQ ID NO: 207 | flanking_5UTR |
| ZNF615 | rs1978717 | C/T | SEQ ID NO: 208 | NONSYN |
| ZNF761 | rs1984432 | A/G | SEQ ID NO: 209 | NONSYN |
| KLK2 | rs198977 | C/T | SEQ ID NO: 210 | NONSYN |
| IFIH1 | rs1990760 | C/T | SEQ ID NO: 211 | NONSYN |
| MAGEA1 | rs2008160 | A/C/G/T | SEQ ID NO: 212 | NONSYN |
| CLEC4A | rs2024301 | A/T | SEQ ID NO: 213 | NONSYN |
| DPPA3 | rs2024320 | C/G | SEQ ID NO: 214 | NONSYN |
| TAPBPL | rs2041385 | C/T | SEQ ID NO: 215 | NONSYN |
| C6orf10 | rs1033500 | C/T | SEQ ID NO: 81 | NONSYN |
| IL13 | rs20541 | C/T | SEQ ID NO: 217 | NONSYN |
| IL4R | rs2057768 | A/G | SEQ ID NO: 218 | flanking_5UTR |
| FPR1 | rs2070745 | C/G | SEQ ID NO: 219 | NONSYN |
| IL4 | rs2070874 | C/T | SEQ ID NO: 220 | 5UTR |
| BIRC5 | rs2071214 | A/G | SEQ ID NO: 221 | NONSYN |
| MAGEB3 | rs2071309 | C/T | SEQ ID NO: 222 | NONSYN |
| TAPBP | rs2071888 | C/G | SEQ ID NO: 223 | NONSYN |
| AKAP3 | rs2072355 | A/C/G/T | SEQ ID NO: 224 | NONSYN |
| ZBP1 | rs2073145 | A/G | SEQ ID NO: 225 | NONSYN |
| DHX58 | rs2074158 | A/G | SEQ ID NO: 226 | NONSYN |
| DHX58 | rs2074160 | A/G | SEQ ID NO: 227 | NONSYN |
| VARS2 | rs2074506 | A/C | SEQ ID NO: 228 | NONSYN |
| KLK9 | rs2075802 | A/C | SEQ ID NO: 229 | SYNON |
| SIGLEC9 | rs2075803 | A/G | SEQ ID NO: 230 | NONSYN |

TABLE 1-continued

| Gene | Alteration/SNP reference | Polymorphism | Sequence reference | Coding status |
|---|---|---|---|---|
| CEBPZ | rs2098386 | A/C/G/T | SEQ ID NO: 231 | NONSYN |
| ZNF347 | rs2195310 | A/G | SEQ ID NO: 232 | NONSYN |
| IL15RA | rs2228059 | A/C | SEQ ID NO: 233 | NONSYN |
| DCC | rs2229080 | C/G | SEQ ID NO: 234 | NONSYN |
| LTA | rs2229094 | C/T | SEQ ID NO: 235 | NONSYN |
| DOCK1 | rs2229603 | A/G | SEQ ID NO: 236 | NONSYN |
| ICAM3 | rs2230399 | C/G | SEQ ID NO: 237 | NONSYN |
| TNFAIP3 | rs2230926 | G/T | SEQ ID NO: 238 | NONSYN |
| GZMB | rs2236338 | A/G | SEQ ID NO: 239 | NONSYN |
| NCR2 | rs2236369 | C/T | SEQ ID NO: 240 | NONSYN |
| EGF | rs2237051 | A/G | SEQ ID NO: 241 | NONSYN |
| DPCR1 | rs2240804 | C/T | SEQ ID NO: 242 | NONSYN |
| LILRA4 | rs2241384 | C/T | SEQ ID NO: 243 | NONSYN |
| Klkbl4 | rs2241414 | A/C/G/T | SEQ ID NO: 244 | NONSYN |
| ATG16L1 | rs2241880 | C/T | SEQ ID NO: 245 | NONSYN |
| SLC44A4 | rs2242665 | A/G | SEQ ID NO: 246 | NONSYN |
| MGC23985 | rs2250145 | A/C/G/T | SEQ ID NO: 247 | NONSYN |
| MMP9 | rs2250889 | C/G | SEQ ID NO: 248 | NONSYN |
| IFNAR1 | rs2257167 | C/G | SEQ ID NO: 249 | NONSYN |
| CYP3A7 | rs2257401 | C/G | SEQ ID NO: 250 | NONSYN |
| SIGLEC9 | rs2258983 | A/C | SEQ ID NO: 251 | NONSYN |
| THG1L | rs2270812 | A/G | SEQ ID NO: 252 | NONSYN |
| NCR2 | rs2273962 | A/G | SEQ ID NO: 253 | NONSYN |
| LEMD1 | rs2274702 | G/T | SEQ ID NO: 254 | intron |
| MMP9 | rs17577 | A/G | SEQ ID NO: 255 | NONSYN |
| FCRLA | rs2275603 | A/G | SEQ ID NO: 256 | NONSYN |
| PZP | rs2277413 | C/T | SEQ ID NO: 257 | NONSYN |
| CCDC33 | rs2277603 | A/G/T | SEQ ID NO: 258 | NONSYN |
| ZNF350 | rs2278420 | A/C/G/T | SEQ ID NO: 259 | NONSYN |
| WDR55 | rs2286394 | A/G | SEQ ID NO: 260 | NONSYN |
| PTPRH | rs2288419 | A/C/G/T | SEQ ID NO: 261 | NONSYN |
| PTPRH | rs2288515 | A/C/G/T | SEQ ID NO: 262 | NONSYN |
| PTPRH | rs2288523 | A/C/G/T | SEQ ID NO: 263 | NONSYN |
| MORC1 | rs2290057 | C/T | SEQ ID NO: 264 | NONSYN |
| RBP5 | rs2290237 | A/T | SEQ ID NO: 265 | NONSYN |
| NOS2A | rs2297518 | A/G | SEQ ID NO: 266 | NONSYN |
| CDX1 | rs2302275 | C/G | SEQ ID NO: 267 | NONSYN |
| SPINK5 | rs2303063 | A/G | SEQ ID NO: 268 | NONSYN |
| THEG | rs2303810 | A/C | SEQ ID NO: 269 | NONSYN |
| FAT2 | rs2304024 | C/T | SEQ ID NO: 270 | NONSYN |
| FAT2 | rs2304053 | A/G | SEQ ID NO: 271 | NONSYN |
| GP6 | rs2304167 | A/C/G/T | SEQ ID NO: 272 | NONSYN |
| ORC4L | rs2307394 | A/G | SEQ ID NO: 273 | NONSYN |
| C19orf51 | rs2365725 | C/T | SEQ ID NO: 274 | NONSYN |
| CASC5 | rs2412541 | G/T | SEQ ID NO: 275 | NONSYN |
| CHRNA2 | rs2472553 | C/T | SEQ ID NO: 276 | NONSYN |
| PTPN22 | rs2476601 | C/T | SEQ ID NO: 277 | NONSYN |
| CCDC69 | rs248427 | A/C/G/T | SEQ ID NO: 278 | NONSYN |
| OLFML2B | rs2499836 | C/T | SEQ ID NO: 279 | NONSYN |
| PCDHA9 | rs251354 | C/G | SEQ ID NO: 280 | NONSYN |
| TRIM31 | rs2523989 | A/G | SEQ ID NO: 281 | NONSYN |
| LILRB3 | rs255772 | C/G | SEQ ID NO: 282 | intron |
| P2RX4 | rs25644 | A/G | SEQ ID NO: 283 | NONSYN |
| CD14 | rs2569190 | A/G | SEQ ID NO: 284 | 5UTR |
| KLK14 | rs2569491 | A/C/G/T | SEQ ID NO: 285 | NONSYN |
| MORC1 | rs2593943 | A/G | SEQ ID NO: 286 | NONSYN |
| CXCL12 | rs266088 | C/T | SEQ ID NO: 287 | intron |
| NCR3 | rs2736191 | C/G | SEQ ID NO: 288 | flanking_5UTR |
| CAGE1 | rs2876098 | G/T | SEQ ID NO: 289 | NONSYN |
| PCDHB12 | rs2910006 | C/T | SEQ ID NO: 290 | NONSYN |
| PCDHB7 | rs2910313 | C/G | SEQ ID NO: 291 | NONSYN |
| KIR2DS4 | rs1130476 | G/T | SEQ ID NO: 292 | NONSYN |
| SLU7 | rs2961944 | A/G | SEQ ID NO: 293 | NONSYN |
| CTLA4 | rs3087243 | A/G | SEQ ID NO: 294 | flanking_3UTR |
| C6orf10 | rs3129941 | A/G | SEQ ID NO: 295 | NONSYN |
| C6orf47 | rs3130617 | C/T | SEQ ID NO: 296 | NONSYN |
| CDSN | rs3130981 | C/T | SEQ ID NO: 297 | NONSYN |
| CDSN | rs3130984 | C/T | SEQ ID NO: 298 | NONSYN |
| LECT2 | rs31517 | A/C/G/T | SEQ ID NO: 299 | NONSYN |
| ETFB | s1130426 | C/T | SEQ ID NO: 300 | NONSYN |
| SELL | rs1131498 | C/T | SEQ ID NO: 301 | NONSYN |
| IL7R | rs3194051 | A/G | SEQ ID NO: 302 | NONSYN |
| SIGIRR | rs3210908 | A/G | SEQ ID NO: 303 | NONSYN |
| ERCC1 | rs3212961 | A/C | SEQ ID NO: 304 | intron |
| PZP | rs3213831 | C/T | SEQ ID NO: 305 | NONSYN |
| TEX15 | rs323344 | A/C/G/T | SEQ ID NO: 306 | NONSYN |
| TEX15 | rs323345 | A/C/G/T | SEQ ID NO: 307 | NONSYN |

TABLE 1-continued

| Gene | Alteration/SNP reference | Polymorphism | Sequence reference | Coding status |
|---|---|---|---|---|
| TEX15 | rs323346 | A/C/G/T | SEQ ID NO: 308 | NONSYN |
| TEX15 | rs323347 | A/C/G/T | SEQ ID NO: 309 | NONSYN |
| ZNF528 | rs324125 | A/G | SEQ ID NO: 310 | flanking_5UTR |
| KIAA0141 | rs351260 | C/T | SEQ ID NO: 311 | NONSYN |
| ZNF701 | rs366793 | C/T | SEQ ID NO: 312 | NONSYN |
| P2RX7 | rs10160951 | C/G | SEQ ID NO: 79 | NONSYN |
| CD180 | rs3733910 | A/G | SEQ ID NO: 314 | SYNON |
| FAT2 | rs3734055 | A/C/G/T | SEQ ID NO: 315 | NONSYN |
| SYCE1 | rs3737031 | A/C/G/T | SEQ ID NO: 316 | NONSYN |
| C1RL | rs3742089 | A/G | SEQ ID NO: 317 | NONSYN |
| KIR3DL2 | rs3745902 | C/T | SEQ ID NO: 318 | NONSYN |
| IFIH1 | rs3747517 | A/G | SEQ ID NO: 319 | NONSYN |
| SYCE1 | rs3747881 | A/C/G/T | SEQ ID NO: 320 | NONSYN |
| SLC25A2 | rs3749780 | A/G/T | SEQ ID NO: 321 | NONSYN |
| C6orf10 | rs3749966 | C/T | SEQ ID NO: 322 | NONSYN |
| P2RX7 | rs3751142 | A/C | SEQ ID NO: 323 | SYNON |
| P2RX7 | rs3751143 | G/T | SEQ ID NO: 324 | NONSYN |
| UGT1A5 | rs3755321 | A/G | SEQ ID NO: 325 | NONSYN |
| MPHOSPH1 | rs1129777 | C/G | SEQ ID NO: 326 | NONSYN |
| MPHOSPH1 | rs3758388 | A/T | SEQ ID NO: 327 | NONSYN |
| MPHOSPH1 | rs3758390 | A/G | SEQ ID NO: 328 | NONSYN |
| CYP2C19 | rs3758581 | A/G | SEQ ID NO: 329 | NONSYN |
| NME1-NME2 | rs3760468 | A/T | SEQ ID NO: 330 | flanking_5UTR |
| NME1-NME2 | rs3760469 | G/T | SEQ ID NO: 331 | flanking_5UTR |
| MORC1 | rs3762697 | A/G | SEQ ID NO: 332 | NONSYN |
| IL1RL1 | rs3771175 | A/T | SEQ ID NO: 333 | 3UTR |
| TLR3 | rs3775291 | A/G | SEQ ID NO: 334 | NONSYN |
| PCDHB6 | rs3776096 | C/T | SEQ ID NO: 335 | NONSYN |
| SPINK5 | rs3777134 | C/T | SEQ ID NO: 336 | NONSYN |
| PBK | rs3779620 | A/G | SEQ ID NO: 337 | NONSYN |
| TDRD6 | rs3799277 | C/T | SEQ ID NO: 338 | NONSYN |
| TIRAP | rs3802813 | A/G | SEQ ID NO: 339 | NONSYN |
| TIRAP | rs3802814 | A/G | SEQ ID NO: 340 | SYNON |
| FATE1 | rs3810715 | A/G | SEQ ID NO: 341 | NONSYN |
| Klkbl4 | rs3815803 | A/C/G/T | SEQ ID NO: 342 | NONSYN |
| ATP10A | rs3816800 | C/G | SEQ ID NO: 343 | NONSYN |
| SIGLEC12 | rs3829658 | A/C/G/T | SEQ ID NO: 344 | NONSYN |
| IRAK2 | rs3844283 | C/G | SEQ ID NO: 345 | NONSYN |
| UGT1A5 | rs3892170 | C/G | SEQ ID NO: 346 | NONSYN |
| IL1R1 | rs3917320 | A/C | SEQ ID NO: 347 | SYNON |
| GALC | rs398607 | A/G | SEQ ID NO: 348 | NONSYN |
| FBXL21 | rs40986 | A/G | SEQ ID NO: 349 | NONSYN |
| NOTCH4 | rs422951 | A/C/G/T | SEQ ID NO: 350 | NONSYN |
| IRAK4 | rs4251545 | A/G | SEQ ID NO: 351 | NONSYN |
| CLEC4D | rs4304840 | A/G | SEQ ID NO: 352 | NONSYN |
| SKIV2L | rs437179 | G/T | SEQ ID NO: 353 | NONSYN |
| NLRP4 | rs441827 | C/T | SEQ ID NO: 354 | NONSYN |
| CTLA4 | rs4553808 | A/G | SEQ ID NO: 355 | flanking_5UTR |
| SSX9 | rs4598385 | A/G | SEQ ID NO: 356 | NONSYN |
| FLJ41603 | rs4629585 | A/C | SEQ ID NO: 357 | NONSYN |
| VARS2 | rs4678 | C/T | SEQ ID NO: 358 | NONSYN |
| EGF | rs4698803 | A/T | SEQ ID NO: 359 | NONSYN |
| PCYOX1L | rs4705336 | C/G | SEQ ID NO: 360 | NONSYN |
| C19orf48 | rs4801853 | C/T | SEQ ID NO: 361 | NONSYN |
| ZNF578 | rs4802965 | A/G | SEQ ID NO: 362 | NONSYN |
| SAGE1 | rs4829799 | C/T | SEQ ID NO: 363 | NONSYN |
| TNFRSF10A | rs20575 | C/G | SEQ ID NO: 364 | NONSYN |
| CD14 | rs4914 | C/G | SEQ ID NO: 365 | SYNON |
| AHSG | rs4918 | C/G | SEQ ID NO: 366 | NONSYN |
| LOC283755 | rs4931826 | A/C | SEQ ID NO: 367 | NONSYN |
| SERPINA3 | rs4934 | A/G | SEQ ID NO: 368 | NONSYN |
| CCDC71 | rs4955418 | A/G | SEQ ID NO: 369 | NONSYN |
| CCDC71 | rs4955419 | A/T | SEQ ID NO: 370 | NONSYN |
| TLR4 | rs4986790 | A/G | SEQ ID NO: 371 | NONSYN |
| TLR4 | rs4986791 | C/T | SEQ ID NO: 372 | NONSYN |
| IFNAR2 | rs2229207 | C/T | SEQ ID NO: 373 | NONSYN |
| SELL | rs2229969 | C/T | SEQ ID NO: 374 | NONSYN |
| IL1RL1 | rs4988956 | A/G | SEQ ID NO: 375 | NONSYN |
| IL1RL1 | rs4988957 | C/T | SEQ ID NO: 376 | SYNON |
| IL1RL1 | rs4988958 | C/T | SEQ ID NO: 377 | SYNON |
| TLR4 | rs5030710 | C/T | SEQ ID NO: 378 | SYNON |
| TLR4 | rs5030719 | G/T | SEQ ID NO: 379 | NONSYN |
| FPR1 | rs5030878 | C/T | SEQ ID NO: 380 | NONSYN |
| TLR4 | rs5031050 | A/T | SEQ ID NO: 381 | NONSYN |
| COP1 | rs542571 | A/T | SEQ ID NO: 382 | NONSYN |
| ICAM1 | rs5498 | A/G | SEQ ID NO: 383 | NONSYN |
| KLK1 | rs5516 | C/G | SEQ ID NO: 384 | NONSYN |

TABLE 1-continued

| Gene | Alteration/SNP reference | Polymorphism | Sequence reference | Coding status |
|---|---|---|---|---|
| KLK1 | rs5517 | A/C/G/T | SEQ ID NO: 385 | NONSYN |
| C6orf10 | rs560505 | C/T | SEQ ID NO: 386 | NONSYN |
| TLR7 | rs5741881 | A/G | SEQ ID NO: 387 | SYNON |
| CTLA4 | rs5742909 | C/T | SEQ ID NO: 388 | flanking_5UTR |
| NOD2 | rs5743291 | A/G | SEQ ID NO: 389 | NONSYN |
| TLR9 | rs5743846 | A/G | SEQ ID NO: 390 | NONSYN |
| CASP1 | rs580253 | A/C/G/T | SEQ ID NO: 391 | SYNON |
| ITGB3 | rs5918 | C/T | SEQ ID NO: 392 | NONSYN |
| PASD1 | rs5924658 | C/G/T | SEQ ID NO: 393 | NONSYN |
| DDX53 | rs5925720 | G/T | SEQ ID NO: 394 | NONSYN |
| CTCFL | rs6025606 | A/C/G/T | SEQ ID NO: 395 | NONSYN |
| CCND1 | rs9344 | A/G | SEQ ID NO: 396 | SYNON |
| CTCFL | rs6070122 | C/G | SEQ ID NO: 397 | NONSYN |
| CTCFL | rs6070128 | C/G | SEQ ID NO: 398 | NONSYN |
| TMC4 | rs641738 | C/T | SEQ ID NO: 399 | NONSYN |
| SLC44A4 | rs644827 | C/T | SEQ ID NO: 400 | NONSYN |
| SIGLEC12 | rs6509544 | C/G | SEQ ID NO: 401 | NONSYN |
| TNFRSF10A | rs6557634 | C/T | SEQ ID NO: 402 | NONSYN |
| FAT2 | rs6650971 | C/T | SEQ ID NO: 403 | NONSYN |
| SPANXN3 | rs6654212 | C/G | SEQ ID NO: 404 | NONSYN |
| UGT1A4 | rs6755571 | A/C | SEQ ID NO: 405 | NONSYN |
| UGT1A6 | rs6759892 | G/T | SEQ ID NO: 406 | NONSYN |
| CCDC110 | rs6827370 | C/T | SEQ ID NO: 407 | NONSYN |
| MYD88 | rs6853 | A/G | SEQ ID NO: 408 | 3UTR |
| SH3TC2 | rs6875902 | A/C | SEQ ID NO: 409 | NONSYN |
| SPINK5 | rs6892205 | A/G | SEQ ID NO: 410 | NONSYN |
| IL7R | rs6897932 | C/T | SEQ ID NO: 411 | NONSYN |
| HCG9 | rs6904029 | A/G | SEQ ID NO: 412 | NONSYN |
| RPP21 | rs6986 | C/G | SEQ ID NO: 413 | NONSYN |
| IRAK2 | rs708035 | A/T | SEQ ID NO: 414 | NONSYN |
| NCAPD2 | rs714774 | C/G | SEQ ID NO: 415 | NONSYN |
| CASC5 | rs7177192 | C/G | SEQ ID NO: 416 | NONSYN |
| TULP2 | rs7260579 | C/T | SEQ ID NO: 417 | NONSYN |
| LIPI | rs7278737 | G/T | SEQ ID NO: 418 | NONSYN |
| LILRB4 | rs731170 | A/G | SEQ ID NO: 419 | NONSYN |
| CTLA4 | rs733618 | A/G | SEQ ID NO: 420 | flanking_5UTR |
| GSTM3 | rs7483 | A/G | SEQ ID NO: 421 | NONSYN |
| NLRP3 | rs7525979 | C/T | SEQ ID NO: 422 | SYNON |
| TRIM40 | rs757259 | C/T | SEQ ID NO: 423 | NONSYN |
| TRIM40 | rs757262 | A/G | SEQ ID NO: 424 | NONSYN |
| SH3RF2 | rs758037 | C/T | SEQ ID NO: 425 | NONSYN |
| FMR1NB | rs764631 | C/T | SEQ ID NO: 426 | NONSYN |
| CCDC110 | rs7698680 | A/T | SEQ ID NO: 427 | NONSYN |
| CCDC110 | rs7699687 | G/T | SEQ ID NO: 428 | NONSYN |
| TLR4 | rs7869402 | C/T | SEQ ID NO: 429 | 3UTR |
| TLR4 | rs7873784 | C/G | SEQ ID NO: 430 | 3UTR |
| P2RX7 | rs7958311 | A/G | SEQ ID NO: 431 | NONSYN |
| HSP90AA1 | rs8005905 | A/T | SEQ ID NO: 432 | NONSYN |
| ZNF614 | rs8104890 | C/T | SEQ ID NO: 433 | NONSYN |
| ZNF160 | rs8105668 | C/G | SEQ ID NO: 434 | NONSYN |
| BIRC8 | rs8109165 | A/G | SEQ ID NO: 435 | NONSYN |
| TULP2 | rs8112811 | C/T | SEQ ID NO: 436 | NONSYN |
| GZMB | rs8192917 | A/G | SEQ ID NO: 437 | NONSYN |
| SP100 | rs836237 | C/T | SEQ ID NO: 438 | flanking_3UTR |
| TLR7 | rs864058 | C/T | SEQ ID NO: 439 | SYNON |
| FPR1 | rs867228 | A/C | SEQ ID NO: 440 | NONSYN |
| LAG3 | rs870849 | C/T | SEQ ID NO: 441 | NONSYN |
| LOC284297 | rs925878 | A/G | SEQ ID NO: 442 | flanking_5UTR |
| C6orf10 | rs9268368 | C/T | SEQ ID NO: 443 | NONSYN |
| C6orf10 | rs9268384 | A/G | SEQ ID NO: 444 | NONSYN |
| PTPRH | rs9304763 | C/G | SEQ ID NO: 445 | SYNON |
| FLJ41603 | rs9324624 | C/T | SEQ ID NO: 446 | NONSYN |
| FAT2 | rs9324700 | A/C/G/T | SEQ ID NO: 447 | NONSYN |
| ZNF614 | rs9636139 | A/G | SEQ ID NO: 448 | NONSYN |
| ZNF468 | rs9749312 | A/G | SEQ ID NO: 449 | 3UTR |
| SLC36A3 | rs978012 | A/G | SEQ ID NO: 450 | NONSYN |
| NCR3 | rs986475 | C/T | SEQ ID NO: 451 | 3UTR |
| CTAGE1 | rs9946136 | A/C/G/T | SEQ ID NO: 452 | NONSYN |

Immune genes are preferably selected the NLR family pyrin domain containing 4 (NLRP4/NALP4/PAN2/CT58) gene, DDX58 [DEAD (Asp-Glu-Ala-Asp, SEQ ID NO: 531) box polypeptide 58] or RIG1 gene, the chemokine (C-X3-C motif) receptor 1 (CX3CR1/Fractalkine receptor/CMK-BLR1/GPR13/V28) gene, MTHFR [methylene tetrahydrofolate reductase] (NADPH) gene, FAT2 gene [human fat homolog proto-cadherin Fat2 (of the fly fat gene which is a tumor suppressor gene controlling cell proliferation) localized in 5q33 region], AHR (BHLHE76) gene, the tumor necrosis factor receptor superfamily member 10a (TNFRSF10A/TRAILR1/CD261) gene, the sialic acid binding Ig-like lectin 5 (SIGLEC5/CD170/OBBP2/CD33L2) gene, the CPX chromosome region candidate 1 (CPXCR1/CT77) gene, the IFNG or IFNγ receptor 1 (IFNGR1/CD119) gene, and the myotubularin related protein 15 (MTMR15/KIAA1018).

Table 2 identifies, for each identified immune gene, SNP(s) associated to a non-responder status of the subject (in other words, to the inability of the subject to induce an anticancer immune response).

TABLE 2

| Gene | Alteration/SNP reference | Polymorphism | Sequence reference | Coding_status |
|---|---|---|---|---|
| NLRP4 | rs302453 | A/T | SEQ ID NO: 60 | NONSYN |
|  | rs17857373 | C/G | SEQ ID NO: 61 | NONSYN |
|  | rs17857374 | A/C/T | SEQ ID NO: 62 | NONSYN |
|  | rs34627915 | A/G | SEQ ID NO: 63 | NONSYN |
|  | rs17854614 | A/C | SEQ ID NO: 64 | NONSYN |
| DDX58 | rs17217280 | A/T | SEQ ID NO: 17 | NONSYN |
|  | rs35253851 | A/C | SEQ ID NO: 18 | NONSYN |
|  | rs951618 | A/G | SEQ ID NO: 19 | NONSYN |
|  | rs35527044 | G/T | SEQ ID NO: 20 | NONSYN |
|  | rs11795404 | A/C | SEQ ID NO: 21 | NONSYN |
|  | rs10813831 | A/G | SEQ ID NO: 22 | NONSYN |
|  | rs11899 | C/T | SEQ ID NO: 23 | 3UTR |
|  | rs10363 | A/G | SEQ ID NO: 24 | 3UTR |
|  | rs10970987 | A/C/G/T | SEQ ID NO: 25 | SYN |
|  | rs35050877 | A/C/G/T | SEQ ID NO: 26 | 3UTR |
|  | rs12236816 | A/G | SEQ ID NO: 27 | 3UTR |
|  | rs12235719 | A/T | SEQ ID NO: 28 | 5UTR |
| CX3CR1 | rs3732378 | A/G | SEQ ID NO: 39 | NONSYN |
|  | rs3732380 | C/T | SEQ ID NO: 40 | NONSYN |
|  | rs41535248 | G/T | SEQ ID NO: 41 | NONSYN |
|  | rs11715522 | A/C | SEQ ID NO: 42 | flanking_5UTR |
|  | rs7636125 | C/G | SEQ ID NO: 43 | 3UTR |
|  | rs11710546 | A/G | SEQ ID NO: 44 | 3UTR |
|  | rs17038674 | C/T | SEQ ID NO: 45 | 3UTR |
|  | rs1050592 | C/T | SEQ ID NO: 46 | 3UTR |
|  | rs4986872 | C/T | SEQ ID NO: 47 | SYN |
|  | rs17038679 | A/G | SEQ ID NO: 48 | SYN |
| MTHFR | Rs1801133 | C/T | SEQ ID NO: 194 | NONSYN |
| AHR | rs10250822 | C/T | SEQ ID NO: 3 | intron |
|  | rs11505406 | C/T | SEQ ID NO: 4 | intron |
|  | rs1476080 | A/C | SEQ ID NO: 5 | intron |
|  | rs17779352 | C/T | SEQ ID NO: 6 | SYN |
|  | rs2066853 | A/G | SEQ ID NO: 7 | NONSYN |
|  | rs2074113 | A/C | SEQ ID NO: 8 | intron |
|  | rs2158041 | A/G | SEQ ID NO: 9 | intron |
|  | rs2282885 | C/T | SEQ ID NO: 10 | intron |
|  | rs34938955 | C/T | SEQ ID NO: 11 | 5UTR |
|  | rs35225673 | A/C/G/T | SEQ ID NO: 12 | intron |
|  | rs4986826 | A/G | SEQ ID NO: 13 | NONSYN |
|  | rs713150 | C/G | SEQ ID NO: 14 | intron |
|  | rs7796976 | A/G | SEQ ID NO: 15 | 5UTR |
|  | rs7811989 | A/G | SEQ ID NO: 16 | intron |
| TNFRSF10A | rs2230229 | A/C/G/T | SEQ ID NO: 29 | NONSYN |
|  | rs17088980 | G/T | SEQ ID NO: 30 | NONSYN |
|  | rs20576 | A/C | SEQ ID NO: 31 | NONSYN |
|  | rs20575 | C/G | SEQ ID NO: 32 | NONSYN |
|  | rs11986840 | C/G | SEQ ID NO: 33 | NONSYN |
|  | rs20577 | C/T | SEQ ID NO: 34 | NONSYN |
|  | rs34737614 | G/T | SEQ ID NO: 35 | NONSYN |
|  | rs34127830 | A/C/G/T | SEQ ID NO: 36 | 3UTR |
|  | rs2230230 | C/T | SEQ ID NO: 37 | SYN |
|  | rs3808537 | C/T | SEQ ID NO: 38 | 5UTR |
| SIGLEC5 | rs3829655 | C/G | SEQ ID NO: 49 | NONSYN |
|  | rs8108074 | A/C/G/T | SEQ ID NO: 50 | NONSYN |
|  | rs2278831 | A/C/G/T | SEQ ID NO: 51 | NONSYN |
|  | rs34553740 | C/T | SEQ ID NO: 52 | NONSYN |
|  | rs1973019 | A/G | SEQ ID NO: 53 | NONSYN |
|  | rs17740650 | A/C/G/T | SEQ ID NO: 54 | SYN |
|  | rs8107754 | A/C/G/T | SEQ ID NO: 55 | SYN |
| CPXCR1 | rs5984611 | A/G | SEQ ID NO: 56 | NONSYN |
|  | rs5940915 | A/C | SEQ ID NO: 57 | NONSYN |
|  | rs41307393 | C/G | SEQ ID NO: 58 | NONSYN |
|  | rs12556970 | C/T | SEQ ID NO: 59 | 3UTR |
| IFNGR1 | rs1327475 | C/T | SEQ ID NO: 65 | intron |
|  | rs1887415 | C/T | SEQ ID NO: 66 | NONSYN |
|  | rs17175350 | A/C | SEQ ID NO: 67 | NONSYN |
|  | rs17175322 | A/G | SEQ ID NO: 68 | NONSYN |
|  | rs11575936 | A/G | SEQ ID NO: 69 | NONSYN |
|  | rs7769141 | A/C | SEQ ID NO: 70 | 3UTR |
|  | rs17181562 | A/G | SEQ ID NO: 71 | 3UTR |
|  | rs11914 | G/T | SEQ ID NO: 72 | SYN |

TABLE 2-continued

| Gene | Alteration/SNP reference | Polymorphism | Sequence reference | Coding_status |
|---|---|---|---|---|
| MTMR15 | rs4779794 | A/G | SEQ ID NO: 73 | NONSYN |
|  | rs17846417 | A/G | SEQ ID NO: 74 | NONSYN |
|  | rs34722914 | A/G | SEQ ID NO: 75 | 5UTR |
|  | rs8023700 | A/G | SEQ ID NO: 76 | 3UTR |
| FAT2 | rs1432862 | C/T | SEQ ID NO: 162 | Missense |
|  | rs2053028 | T/C | SEQ ID NO: 216 | Missense |
|  | rs6650971 | G/A | SEQ ID NO: 403 | Missense |

The method is typically performed on the nucleic acid obtained from cells of a biological sample (blood or serum for example) of the subject, for example on the genomic DNA obtained from blood or seric cells, in particular leukocytes, more preferably Peripheral Blood Mononuclear Cells (PBMC), which are non cancerous cells.

The method may also be performed on tumoral cells of the subject whose normal cells (non cancerous cells) have an altered genotype.

Inventors herein demonstrate that a "compensatory immunogenic treatment of cancer", as disclosed in the present description, should be administered, preferably in addition to a conventional treatment of cancer, to such resistant subjects which are not able to induce an anticancer immune response, in order to allow such a response.

Typically, the alteration in a nucleic acid sequence may be determined at the level of the selected gene (immune gene, specific to the subject, or tumor gene, specific to the tumor), for example AHR DNA, cDNA, RNA or polypeptide. Optionally, the detection is performed by sequencing all or part of the gene locus or by selective hybridization or amplification of all or part of the gene locus. More preferably a gene locus specific amplification is carried out before the alteration identification step. An alteration in the gene locus may be any form of mutation(s), deletion(s), rearrangement(s) and/or insertions in the coding and/or non-coding region of the locus, alone or in various combination(s). Mutations more specifically include point mutations. Deletions may encompass any region of two or more residues in a coding or non-coding portion of the gene locus, such as from two residues up to the entire gene or locus. Typical deletions affect smaller regions, such as domains (introns) or repeated sequences or fragments of less than about 50 consecutive base pairs, although larger deletions may occur as well. Insertions may encompass the addition of one or several residues in a coding or non-coding portion of the gene locus. Insertions may typically comprise an addition of between 1 and 50 base pairs in the gene locus. Rearrangement includes inversion of sequences. The gene locus alteration may result in the creation of stop codons, frameshift mutations, amino acid substitutions, particular RNA splicing or processing, product instability, truncated polypeptide production, etc. The alteration may result in the production of a polypeptide or protein with altered function, stability, targeting or structure. The alteration may also cause a reduction in protein expression or, alternatively, an increase in said production.

In a preferred embodiment, said alteration is a mutation, an insertion or a deletion of one or more bases. In a particular embodiment of the method according to the present invention, the alteration in the gene locus is selected from a point mutation, a deletion and an insertion in the gene or corresponding expression product, more preferably a point mutation and a deletion. The alteration may be determined at the level of the DNA, RNA or polypeptide.

Within the context of this invention, the "gene locus", for example "the AHR gene locus", designates all sequences or products in a cell or organism including, regarding AHR for example, the AHR coding sequences, AHR non-coding sequences (e.g., introns), AHR regulatory sequences controlling transcription and/or translation (e.g., promoter, enhancer/silencer regions, terminator, 5'UTR, 3'UTR, etc.), all corresponding expression products, such as AHR RNAs (e.g., mRNAs) and AHR polypeptides (e.g., a pre-protein and a mature protein); as well as surrounding sequences of 20 kb region, preferably 15.3 kb region, upstream the starting codon (flanking the 5'UTR region) of the AHR gene and 20 kb region, preferably 14.1 kb region, downstream the untranslated region (flanking the 3'UTR region). In a particular embodiment most alterations are not in the promoter sequence.

In a particular embodiment of the present invention, the step of determining the ability of the subject to induce an anticancer immune response may consist in determining alteration in a gene locus (in particular an immune gene locus) or in the expression of the protein encoded by said gene, in a biological sample of the patient, the presence of such an alteration being indicative of the inability of the subject to induce an anticancer immune response.

Alteration of a nucleic acid sequence herein described (in relation with the tumor or with the subject) is preferably a mutation, an insertion or a deletion of one or more bases. More preferably said alteration is one or several single nucleotide polymorphism(s) (SNPs).

In a particular embodiment, the altered nucleic acid is a wild-type nucleic acid comprising at least one point mutation, preferably a single nucleotide polymorphism (SNP), for example a loss-of-function SNP, i.e., a SNP responsible for the absent or abnormal (non-functional) expression of the protein encoded by the nucleic acid. The wild-type nucleic acid may also comprise several single nucleotide polymorphism(s) (SNPs).

Once a first SNP has been identified in a genomic region of interest, more particularly in an immune gene locus, other additional SNPs in linkage disequilibrium with this first SNP can be identified. Indeed, any SNP in linkage disequilibrium with a first SNP associated with non-responder phenotype will be associated with this trait. Therefore, once the association has been demonstrated between a given SNP and non-responder phenotype, the discovery of additional SNPs associated with this trait can be of great interest in order to increase the density of SNPs in this particular region. Identification of additional SNPs in linkage disequilibrium with a given SNP involves: (a) amplifying a fragment from the genomic region comprising or surrounding a first SNP from a plurality of individuals; (b) identifying of second SNP in the genomic region harboring or surrounding said first SNP; (c) conducting a linkage disequilibrium analysis between said first SNP and second SNP; and (d) selecting said second SNP as being in linkage disequilibrium with said first marker.

Sub-combinations comprising steps (b) and (c) are also contemplated. These SNPs in linkage disequilibrium can also be used in the methods according to the present invention, and more particularly in the methods to predict treatment response or ability to induce an anticancer immune response according to the present invention.

Mutations in a gene locus which are responsible for non-responder phenotype may be identified by comparing the sequences of the gene locus from patients presenting non-responder phenotype and responder phenotype. Based on the identified association of SNPs of the particular gene, the identified locus can be scanned for mutations. In a preferred embodiment, functional regions such as exons and splice sites, promoters and other regulatory regions of the gene locus are scanned for mutations. Preferably, patients presenting non-responder phenotype carry the mutation shown to be associated with non-responder phenotype and responder phenotype do not carry the mutation or mutated allele associated with reduced cancer treatment response. However, in case of certain SNPs (such as those present in NLRP4), the SNPs protect the host against relapse, i.e, is a protective SNP. The method used to detect such mutations generally comprises the following steps: amplification of a region of the gene locus of interest comprising a SNP or a group of SNPs associated with non responder phenotype from DNA samples of the gene locus from patients presenting non responder phenotype and responder phenotype; sequencing of the amplified region; comparison of DNA sequences of the corresponding genes from patients presenting non responder phenotype and responder phenotype; determination of mutations specific to patients presenting non responder phenotype.

In the AHR gene, the SNP may be more particularly selected from rs10250822 (SEQ ID NO: 3), rs11505406 (SEQ ID NO: 4), rs1476080 (SEQ ID NO: 5), rs17779352 (SEQ ID NO: 6), rs2066853 (SEQ ID NO: 7), rs2074113 (SEQ ID NO: 8), rs2158041 (SEQ ID NO: 9), rs2282885 (SEQ ID NO: 10), rs34938955 (SEQ ID NO: 11), rs35225673 (SEQ ID NO: 12), rs4986826 (SEQ ID NO: 13), rs713150 (SEQ ID NO: 14), rs7796976 (SEQ ID NO: 15), and rs7811989 (SEQ ID NO: 16).

A typical SNP in the AHR gene is rs2066853 (SEQ ID NO: 7). Such a SNP AHR A/G (R554K) is indicative of a subject being unable to induce an anticancer immune response. Such a subject is typically non-responder to conventional treatments of cancer.

In the NLRP4 gene, the SNP is preferably rs302453 (SEQ ID NO: 60). Such a SNP NLRP4 A/T (Gln925Leu) is indicative of a subject being able to induce a better anticancer immune response. Such a subject is typically responder to conventional treatments of cancer In the DDX58/RIG-1 gene, the SNP is preferably rs17217280 (SEQ ID NO: 17). Such a SNP DDX58/RIG-1 A/T (Asp508Glu) is indicative of the inability of the subject to respond to conventional treatments of cancer. In other words, the presence of a wild-type allele A in a subject is indicative of being able to induce a better anticancer immune response.

In the CX3CR1 gene, the SNP is preferably rs3732378 (SEQ ID NO: 39). Such a SNP CX3CR1 A/G (Thr280Met) is indicative of the inability of the subject to respond to conventional treatments of cancer. In other words, the presence of a wild-type allele A in a subject is indicative of being able to induce a better anticancer immune response.

In the FAT2 gene, the SNPs are preferably rs1432862 (SEQ ID NO: 162), rs2053028 (SEQ ID NO: 216), rs6650971 (SEQ ID NO: 403). Such SNPs FAT2 C/T (Arg574Cys), T/C (Leu3514Ser), G/A (Met3631Ile) are indicative of a subject being able to induce a better anticancer immune response. Such a subject is typically responder to conventional treatments of cancer. In other words, the presence of a mutated allele in a subject is indicative of being able to induce a better anticancer immune response.

In the methylene tetrahydrofolate reductase MTHFR gene, the SNP is preferably rs1801133 (SEQ ID NO: 194). Such a SNP MTHFR C/T (A222V) is indicative of a subject being able to induce a better anticancer immune response. Such a subject is typically responder to conventional treatments of cancer. In other words, the presence of a wild-type allele C in a subject is indicative of the inability of the subject to respond to conventional treatments of cancer.

A particular method herein described comprises, in addition to previously described steps, a step of controlling, in a tumor, blood or serum sample of the subject, the presence of a herein described single nucleotide polymorphism (SNP); the detection of at least one of:

i. an abnormal expression of the proteins encoded by (i) a gene encoding CCR1, (ii) a gene encoding EIF2AK2, and (iii) a gene encoding DNAJC10 or PDIA3, and ii. an alteration in the gene encoding MTHFR, being indicative of a resistance of the subject to a therapeutic treatment of cancer.

Preferably, the alteration is a single nucleotide polymorphism (SNP) corresponding to rs1801133 (wild type allele C/mutated allele T) (SEQ ID NO: 194).

In the NLRP4 gene, the SNP may be more particularly selected from rs302453 (SEQ ID NO: 60), rs17857373 (SEQ ID NO: 61), rs17857374 (SEQ ID NO: 62), rs34627915 (SEQ ID NO: 63) and rs17854614 (SEQ ID NO: 64).

In the DDX58 gene, the SNP may be more particularly selected from rs17217280 (SEQ ID NO: 17), rs35253851 (SEQ ID NO: 18), rs951618 (SEQ ID NO: 19), rs35527044 (SEQ ID NO: 20), rs11795404 (SEQ ID NO: 21), rs10813831 (SEQ ID NO: 22), rs11899 (SEQ ID NO: 23), rs10363 (SEQ ID NO: 24), rs10970987 (SEQ ID NO: 25), rs35050877 (SEQ ID NO: 26), rs12236816 (SEQ ID NO: 27), and rs12235719 (SEQ ID NO: 28).

In the CX3CR1 gene, the SNP may be more particularly selected from rs3732378 (SEQ ID NO: 39), rs3732380 (SEQ ID NO: 40), rs41535248 (SEQ ID NO: 41), rs11715522 (SEQ ID NO: 42), rs7636125 (SEQ ID NO: 43), rs11710546 (SEQ ID NO: 44), rs17038674 (SEQ ID NO: 45), rs1050592 (SEQ ID NO: 46), rs4986872 (SEQ ID NO: 47), and rs17038679 (SEQ ID NO: 48).

In the TNFRSF10A gene, the SNP may be more particularly selected from rs2230229 (SEQ ID NO: 29), rs17088980 (SEQ ID NO: 30), rs20576 (SEQ ID NO: 31), rs20575 (SEQ ID NO: 32), rs11986840 (SEQ ID NO: 33), rs20577 (SEQ ID NO: 34), rs34737614 (SEQ ID NO: 35), rs34127830 (SEQ ID NO: 36), rs2230230 (SEQ ID NO: 37) and rs3808537 (SEQ ID NO: 38).

In the SIGLEC5 gene, the SNP may be more particularly selected from rs3829655 (SEQ ID NO: 49), rs8108074 (SEQ ID NO: 50), rs2278831 (SEQ ID NO: 51), rs34553740 (SEQ ID NO: 52), rs1973019 (SEQ ID NO: 53), rs17740650 (SEQ ID NO: 54), and rs8107754 (SEQ ID NO: 55).

In the CPXCR1 gene, the SNP may be more particularly selected from rs5984611 (SEQ ID NO: 56), rs5940915 (SEQ ID NO: 57), rs41307393 (SEQ ID NO: 58), and rs12556970 (SEQ ID NO: 59).

In the IFNGR1 gene, the SNP may be more particularly selected from rs1327475 (SEQ ID NO: 65), rs1887415 (SEQ ID NO: 66), rs17175350 (SEQ ID NO: 67), rs17175322 (SEQ ID NO: 68), rs11575936 (SEQ ID NO: 69), rs7769141 (SEQ ID NO: 70), rs17181562 (SEQ ID NO: 71), and rs11914 (SEQ ID NO: 72).

In the MTMR15 gene, the SNP may be more particularly selected from rs4779794 (SEQ ID NO: 73), rs17846417 (SEQ ID NO: 74), rs34722914 (SEQ ID NO: 75), and rs8023700 (SEQ ID NO: 76).

In the FAT2 gene, the SNP may be more particularly selected from rs1432862 (SEQ ID NO: 162), rs 2053028 (SEQ ID NO: 216), and rs6650971 (SEQ ID NO: 403).

The presence of an alteration in a nucleic acid may be easily detected by the man skilled in the art using methods of the art such as restriction digestion, sequencing, selective hybridisation (for example with a nucleic acid probe present on a nucleotide array), and/or selective amplification, as further explained below.

Alterations in a gene may also be detected by determining the presence of an altered RNA expression. Altered RNA expression includes the presence of an altered RNA sequence, the presence of an altered RNA splicing or processing, the presence of an altered quantity of RNA, etc. These may be detected by various techniques known in the art, including by sequencing all or part of the RNA or by selective hybridisation or selective amplification of all or part of said RNA, for instance.

The presence of an abnormal expression of a target nucleic acid (which may be a nucleic acid from the subject or from the tumor), such as one of those identified previously, may be detected in particular by real time quantitative reverse transcription PCR (qRT-PCR) using probes designed to hybridize within the target nucleic acid sequence (see O'Driscoll L. et al., 1993 and Yajima T. et al, 1998).

In a further variant, the method comprises detecting the presence of an altered expression of the polypeptide or protein encoded by the gene of interest. Altered polypeptide expression includes the presence of an altered polypeptide sequence, the presence of an altered quantity of polypeptide, the presence of an altered tissue distribution, etc. These may be detected by various techniques known in the art, including by sequencing and/or binding to specific ligands (such as antibodies), for instance.

In a particular embodiment, the detection of an abnormal protein expression may be easily performed, by the man skilled in the art, by measuring the cellular level of mRNA encoding a normal protein, a decreased level compared to a control or standard level being correlated to an abnormal protein expression.

Sequencing can be carried out using techniques well known in the art, using automatic sequencers. The sequencing may be performed on the complete gene locus or, more preferably, on specific domains thereof, typically those known or suspected to carry deleterious mutations or other alterations.

Amplification is based on the formation of specific hybrids between complementary nucleic acid sequences that serve to initiate nucleic acid reproduction. Amplification may be performed according to various techniques known in the art, such as by polymerase chain reaction (PCR), ligase chain reaction (LCR), strand displacement amplification (SDA) and nucleic acid sequence based amplification (NASBA). These techniques can be performed using commercially available reagents and protocols. Preferred techniques use allele-specific PCR or PCR-SSCP. Amplification usually requires the use of specific nucleic acid primers, to initiate the reaction. Nucleic acid primers useful for amplifying sequences from the gene locus of interest are able to specifically hybridize with a portion of the gene locus that flank a target region of said locus, said target region being altered, for example in the case of the immune genes, in non responder patients.

Another particular object of this invention resides in a nucleic acid primer useful for amplifying sequences from the gene or locus of interest including surrounding regions. Such primers are preferably complementary to, and hybridize specifically to nucleic acid sequences in the gene locus. Particular primers are able to specifically hybridize with a portion of the gene locus that flank a target region of said locus, said target region being altered, for example in the case of the immune genes, in non responders. Primers that can be used to amplify target region comprising SNPs may be designed based on their sequence or on the genomic sequence of a particular gene.

The invention also relates to a nucleic acid primer, said primer being complementary to and hybridizing specifically to a portion of a gene locus coding sequence (e.g., gene or RNA) altered in certain non responders subjects. In this regard, particular primers of this invention are specific for altered sequences in a gene locus or RNA. By using such primers, the detection of an amplification product indicates the presence of an alteration in the gene locus. In contrast, the absence of amplification product indicates that the specific alteration is not present in the considered sample. The invention also concerns the use of a nucleic acid primer or a pair of nucleic acid primers as mentioned above in a method of determining the treatment response of a subject having a tumor or in a method of assessing the response of a subject to a treatment of cancer.

Hybridization detection methods are based on the formation of specific hybrids between complementary nucleic acid sequences that serve to detect nucleic acid sequence alteration(s). A particular detection technique involves the use of a nucleic acid probe specific for wild-type or altered (immune or tumor) gene or corresponding RNA, followed by the detection of the presence of a hybrid. The probe may be in suspension or immobilized on a substrate or support (as in nucleic acid array or chips technologies). The probe is typically labeled to facilitate detection of hybrids.

In this regard, a particular embodiment of this invention comprises contacting the sample from the subject with a nucleic acid probe specific for an altered immune gene locus, and assessing the formation of an hybrid.

In a particularly preferred embodiment, the method comprises contacting simultaneously the sample with a set of probes that are specific, respectively, for wild type gene locus and for various altered forms thereof. In this embodiment, it is possible to detect directly the presence of various forms of alterations in the gene locus in the sample. Also, various samples from various subjects may be treated in parallel.

Within the context of this invention, a probe refers to a polynucleotide sequence which is complementary to and capable of specific hybridization with a (target portion of) gene or RNA, and which is suitable for detecting polynucleotide polymorphisms associated with the gene alleles which predispose to or are associated with a reduced ability of the subject or of the tumor to induce an anticancer immune response ("mutated allele").

Probes are preferably perfectly complementary to the particular gene, RNA, or target portion thereof. Probes typically comprise single-stranded nucleic acids of between 8 to 1000 nucleotides in length, for instance of between 10 and 800, more preferably of between 15 and 700, typically of between 20 and 500. It should be understood that longer probes may be used as well. A preferred probe of this invention is a single stranded nucleic acid molecule of between 8 to 500 nucleotides in length, which can specifically hybridize to a region of a gene locus or RNA that carries an alteration.

The method of the invention employs a nucleic acid probe specific for an altered (e.g., a mutated) gene or RNA, i.e., a nucleic acid probe that specifically hybridizes to said altered gene or RNA and essentially does not hybridize to a gene or RNA lacking said alteration.

Specificity indicates that hybridization to the target sequence generates a specific signal which can be distinguished from the signal generated through non-specific hybridization. Perfectly complementary sequences are preferred to design probes according to this invention. It should be understood, however, that certain mismatch may be tolerated, as long as the specific signal may be distinguished from non-specific hybridization.

The invention also concerns the use of a nucleic acid probe as described above in a method of determining cancer treatment response of a subject or in a method of assessing the response of a subject to a cancer treatment.

As indicated above, alteration in the (immune or tumor) gene locus may also be detected by screening for alteration(s) in polypeptide sequence or expression levels.

In order to detect a protein on the cell surface, or, in order to detect the presence, in a cell, of a protein, immunohistochemistry (for example in a tumor bed), ELISA (for example in a blood or serum sample), immunoblotting (in particular Western blot), proteomics, or antibody-based biosensors directed against the protein of interest, as well as any other method known from the man of the art, can be applied to a tumour specimen as previously defined (see Obeid et al., 2007 which provide examples of such techniques).

Immunofluorescence staining or FACS (Fluorescent Activated Cell Sorting) analyses (flow cytometry analyses) is an example of an appropriate method to detect the translocation of a particular protein from the inside to the surface of a cell, in particular of a tumour cell that has been previously submitted to a treatment of cancer.

Contacting the sample with a ligand specific for a polypeptide encoded by a particular gene and determining the formation of a complex is also described.

Different types of ligands may be used, such as specific antibodies. In a specific embodiment, the sample is contacted with an antibody specific for a polypeptide encoded by a particular gene and the formation of a complex is determined. Various methods for detecting such a complex can be used, such as ELISA, radio-immunoassays (RIA) and immunoenzymatic assays (IEMA).

Within the context of this invention, an antibody designates a polyclonal antibody, a monoclonal antibody, as well as fragments or derivatives thereof having substantially the same antigen specificity. Fragments include Fab, Fab' 2, CDR regions, etc. Derivatives include single-chain antibodies, humanized antibodies, poly-functional antibodies, etc. An antibody specific for a polypeptide encoded by a particular gene designates an antibody that selectively binds said polypeptide, i.e., an antibody raised against said polypeptide or an epitope-containing fragment thereof. Although non-specific binding towards other antigens may occur, binding to the target polypeptide occurs with a higher affinity and can be reliably discriminated from non-specific binding.

Immunoblotting can in particular be used to measure the degradation of BAP31, the phosphorylation of eIF2alpha, the presence of a protein selected for example from GCN2 and HRI or the activation of a protein selected for example from caspase 8, reticulon-3, PERK, PKR, Bax and Bak in a cell, in particular a tumor cell, more particularly in a tumor cell which has been previously exposed to a cancer treatment, in particular to a conventional cancer treatment.

It is also disclosed kits to predict treatment response or to predict ability to induce an anticancer immune response comprising products and reagents for detecting in a sample from a subject the presence of an alteration in a gene locus or in the corresponding polypeptide or protein; in the gene or corresponding polypeptide or protein expression; and/or in the gene activity.

Such kits comprise any primer, any pair of primers, any nucleic acid probes (wild-type and mutant) and/or any ligand, preferably antibody, described in the present invention. Such kits can further comprise reagents and/or protocols for performing a hybridization, amplification or antigen-antibody immune reaction.

Particular kits are the following kits:

A kit to detect the abnormal expression of a gene selected from CCR1, EIF2Ak2, DNAJC10, PDIA3, EIF2A, PPP1CB, IKBKB, PPP1CC, BAX and combinations thereof, in a tumor sample of the subject, the kit comprising (i) at least one pair of primers, in particular two, three, four, five, six, seven, eight, nine pairs of primers corresponding to the previously mentioned genes, and (ii) at least one probe, preferably a fluorescent probe, allowing the quantitative detection of the expression of a gene selected from CCR1, EIF2Ak2, DNAJC10, PDIA3, EIF2A, PPP1CB, IKBKB, PPP1CC, BAX, preferably at least one fluorescent probe for each of the selected genes of the previously mentioned list of genes, and (iii) a leaflet providing the control quantitative expression values corresponding to at least one of said genes in a control population.

A kit to detect an abnormal expression of a gene selected from AHR and MTHFR (in particular the presence of a polymorphism associated with an abnormal expression of such a gene), in a tumor or blood sample of the subject, the kit comprising (i) at least one pair of primers, preferably two pairs of primers corresponding respectively to the AHR and to the MTHFR gene, and (ii) at least two differently labelled probes, preferably two differently labelled fluorescent probes, the first probe recognizing the wild-type allele and the second probe recognizing the mutated allele of a gene selected from AHR and MTHFR, preferably two differently labelled probes for each of said genes.

A kit to detect the presence of a polymorphism associated with an abnormal expression of a gene selected from FAT2 and MTHFR (for example a kit to detect the presence of a polymorphism associated with an abnormal expression of such a gene), in a tumor or blood sample of the subject, the kit comprising (i) at least one pair of primers, and (ii) at least two differently labelled probes, the first probe recognizing the wild-type allele and the second probe recognizing the mutated allele of a gene selected from FAT2 and MTHFR.

A kit to detect the presence of a polymorphism associated with an abnormal expression of a gene selected from DDX58 (RIG-1) and CX3CR1 (for example a kit to detect the presence of a polymorphism associated with an abnormal expression of such a gene), in a tumor or blood sample of the subject, the kit comprising (i) at least one pair of primers, and (ii) at least two differently labelled probes, the first probe recognizing the wild-type allele and the second probe recognizing the mutated allele of a gene selected from DDX58 and CX3CR1.

A kit to detect the presence of a polymorphism associated with an abnormal expression of a NLRP4 gene (for example a kit to detect the presence of a polymorphism associated with an abnormal expression of such a gene), in a tumor or blood sample of the subject, the kit comprising (i) at least one pair of primers, and (ii) at least two differently labelled probes, the first probe recognizing the wild-type allele and the second probe recognizing the mutated allele of the NLRP4 gene.

A kit comprising:
- a) (i) at least one pair of primers, (ii) at least two distinct probes, preferably different fluorescent probes, allowing the quantitative detection of the expression of a gene selected from CCR1, EIF2Ak2, DNAJC10, PDIA3, EIF2A, PPP1CB, IKBKB, PPP1CC and BAX and (iii) a leaflet providing the control quantitative expression values corresponding to at least one of said genes in a control population; and
- b) (i) at least one pair of primers, and (ii) at least two differently labelled probes, the first probe recognizing the wild-type allele and the second probe recognizing the mutated allele of a gene selected from NLRP4, FAT2 and MTHFR (for neoadjuvant therapy) or TLR4, P2RX7, DDX58 (for adjuvant therapy).

A kit comprising:
- a) several antibodies for immunohistochemistry usage recognizing the core protein machinery of ER stress and autophagy in tissue sections (paraffin embedded- or frozen) such as phosphorylated eif2a, ERp57, calreticulin, HMGB1, LC3 gate 16 GABARAP (gamma-aminobutyric acid receptor-associated protein); and
- b) at least one pair of primers, and (ii) at least two differently labelled probes, the first probe recognizing the wild-type allele and the second probe recognizing the mutated allele of a gene selected from NLRP4, FAT2 and MTHFR (for neoadjuvant therapy) or TLR4, P2RX7, DDX58 (for adjuvant therapy).

The herein described kits may further comprise a microarray or a 96-wells or 384-wells plate to be used for the herein described methods and read through quantitative PCR or multiplex technology.

Compensatory Immunogenic Treatment of Cancer

Inventors advantageously herein provide a new strategy for treating cancer which consists in administering to the subject in need thereof an additional treatment herein identified as "compensatory immunogenic treatment of cancer". As explained previously, a typical subject is a subject resistant to a treatment of cancer, in particular to a conventional treatment of cancer.

This compensatory immunogenic treatment of cancer will allow a reaction from the immune system of the subject having a tumor directed against the tumour cells, or will stimulate such a reaction.

Inventors have in particular discovered that such a compensatory immunogenic treatment of cancer is able to allow or improve the efficiency of a conventional therapy as described above, in a subject in need thereof.

The compensatory immunogenic treatment of cancer according to the present invention typically involves the exogenous supply, administration for example, to the subject, of at least one compensatory product (molecule, compound, drug or therapeutic agent, cell), preferably together with a conventional therapeutic agent used in a treatment as described above (in order to obtain a therapeutic effect, preferably a synergistic effect), said conventional treatment being easily selected by the cancerologist, as exemplified previously, according to the nature of the cancer to be prevented or treated.

The function of a compensatory product, in the context of the present invention, is to allow the immune system to generate a cancer immune response in a subject identified, with a method herein described, as resistant to a treatment of cancer. As largely explained previously, such a resistance may be due to the inability of the treatment of cancer the subject has been exposed to, to the inability of the subject and/or to the inability of the tumor, to induce an anticancer immune response.

The compensatory product may be selected from a protein, as previously herein identified, i) allowing or enhancing CRT, ERp57, LysRS (KARS) and/or KDEL receptor exposure at the surface of tumor cells, ii) allowing or enhancing the secretion of ATP, HMGB1 (High-mobility group box 1), LysRS and/or IL-8, iii) stimulating the autophagy machinery, and/or an ER stress response, iv) recruiting and/or activating specific effectors in tumor beds, such as IL-17 producing γδ T lymphocytes, cytotoxic T cells and dendritic cells, v) promoting activation of the TLR4/myd88 pathway, vi) triggering the NALP3 (Nacht Domain-, Leucine-Rich Repeat-, and PYD-Containing Protein 3) inflammasome.

The compensatory product may also be selected from (i) a product allowing or enhancing the secretion of ATP, HMGB1, LysRS and/or IL-8, and/or the exposure of CRT, ERp57, LysRS and/or KDEL receptor at the surface of a tumour cell, (ii) a product stimulating the autophagy machinery and/or an ER stress response, (iii) a product recruiting and/or activating IL-17 producing γδ T lymphocytes, cytotoxic T cells and/or dendritic cells, (iv) a product promoting activation of the TLR4/myd88 pathway, or able to bypass said pathway, (v) a product triggering the P2RX7 (P2X purinoreceptor 7) and/or the NALP3 inflammasome, (vi) a product allowing or enhancing the secretion of IL-1b, (vii) a product capable of stimulating intratumoral Vd2 T lymphocytes, and (viii) a product selected from an anti-allergic drug, a neurotropic drug, an antihypertensive or cardiotropic drug such as a $Na^+K^+ATPase$ inhibitor, in particular a cardiac glycoside, a spindle poison drug, an antimicrobial drug, an anti-osteoclastic drug, a diuretic drug, an oestrogen, an apyrase inhibitor, and (ix) any combination thereof.

In the present invention, the term "endogenous" means that a particular protein (for example IL-1b) is produced by the cell as a wild-type protein. The wild-type protein has to be distinguished from the recombinant protein (for example rIL-1b), the recombinant protein whose activity, in particular regarding the immune system, is respectively substantially identical to that of the previously mentioned wild-type protein, but which need a human intervention to be produced by the cell.

In the present invention, the term "homologous variant" is used to designate any protein that comprises deleted or substituted amino acid(s), for example any wild-type or recombinant protein or protein fragment that exhibits the properties of the corresponding wild-type protein, in particular that is able to induce a response from the immune system, for example an immunogenic tumor cell death or apoptosis as previously defined.

A preferred "compensatory product" usable in the present invention that allows or enhances the secretion of ATP, HMGB1, LysRS and/or IL-8, and/or the exposure of CRT, ERp57, LysRS and/or KDEL receptor at the surface of a tumour cell, in particular of a dying tumor cell, can be selected from rCRT, rIL-8, inhibitors of PP1/GADD34, chloroquine, TLR7 agonists, antihistaminic drugs such as brompheniramine maleate, bumetanide, cyproheptadine, fenspiride, flunisolide, ketotifene, loratadine and/or cardiotrop drugs such as amlodipine besylate, atenolol, benazepril hydrochloride, nimodipine and/or antimicrobial such as cycloserine, diloxanide furoate, fluconazole, mebendazole, mefloquine and/or neurotrop drugs such as aripiprazole, bromocriptine mesylate, carbamazepine, clozapine, haloperidol, methysergide maleate, mianserin hydrochloride, mirtazapine, olanzapine, paroxetine hydrochloride, perphenazine, pizotyline malate, procyclidine hydrochloride, quetiapine fumarate, rapamycin, risperidone, sertraline hydrochloride, trazodone, ziprasidone and/or spindle poison drugs such as colchicine, doxorubicin, mitoxanthrone hydrochloride, vinblastine sulfate, vincristine sulphate and/or anti-osteoclast drugs such as etidronate disodium, estrogen such as estrone, and/or a Na$^+$K$^+$ATPase inhibitor, in particular a cardiac glycoside such as digoxin, digitoxin, ouabain, proscillaridin, strophantin, sanguinarin, and/or an apyrase inhibitor, and homologous variant thereof.

A preferred "compensatory product" usable in the present invention for stimulating the autophagy machinery may be selected from an apyrase inhibitor such as ecto-nucleoside-triphosphate-diphosphohydrolase (CD39) inhibitor (polyoxometalate 1), 6-N,N-Diethyl-D-beta-gamma-dibromomethylene adenosine triphosphate (ARL 67156), 2'(3')-O-(4-benzoylbenzoyl)-adenosine triphosphate, an antibody inhibiting the ecto-apyrase activity of CD39 and an antibody inhibiting the ecto-5'-nucleotidase activity; spermidin; resveratrol; rapamycin analogs; and/or an ER stress response may be selected from recombinant calreticulin, digoxin, digitoxin, ouabain, strophantin, proscillaridin, sanguinarine, and from an ER stress response inducer, such as thapsigargin (THAPS).

A preferred "compensatory product" usable in the present invention for recruiting and/or activating specific effectors in tumor beds, such as IL-17 producing γδ T lymphocytes, cytotoxic T cells and dendritic cells, may be selected from rIL-1b, rIL-17, rIL-22, a phosphoantigen, a Vδ2 T lymphocytes activator, a leukotrien, a prostaglandin, and a chemokine.

A preferred "compensatory product" usable in the present invention for promoting activation of the TLR4/myd88 pathway, or able to bypass said pathway, may be selected from dendrophilin, a TLR3 ligand such as such as Poly I:C, poly A:U; a TLR9 ligand such as CpG ODN (CpG oligodeoxynucleotides); HMGB1; and chloroquine.

Typically a product capable of promoting activation of the TLR4/myd88 pathway is selected from dendrophilin and any TLR4/myd88 agonists.

A preferred "compensatory product" usable in the present invention for triggering the P2RX7 (P2X purinoceptor 7) and/or the NALP3 inflammasome, may be selected from a TLR7 agonist such as synthetic oligoribonucleotides containing arabinonucleotides, imiquimod and resiquimod; a TLR8 agonist such as polyG10; a recombinant cytokine such as rIL-1b and IL-12; and an inhibitor of apyrases such as ecto-nucleoside-triphosphate-diphosphohydrolase (CD39) inhibitor (polyoxometalate 1), 6-N,N-Diethyl-D-beta-gamma-dibromomethylene adenosine triphosphate (ARL 67156), 2'(3')-O-(4-benzoylbenzoyl)-adenosine triphosphate, an antibody inhibiting the ecto-apyrase activity of CD39 and an antibody inhibiting the ecto-5'-nucleotidase activity.

A preferred "compensatory product" usable in the present invention that allows or enhances the secretion of IL-1b, in particular by an immune cell (as herein defined), can be selected from recombinant IL-12 (rIL-12) and/or recombinant IL-1b (rIL-1b). Such a recombinant cytokine may advantageously be used in combination with a molecule selected from an anti-PD1 (Programmed Death 1) molecule, a B7-DCFc molecule, an antibody directed against CTLA4 (anti-Cytotoxic T-Lymphocyte Antigen 4 Ab) or against 4-1BBL (anti-4-1BBL Ab), a metronomic cyclophosphamide and any combination thereof.

The compensatory molecule may also be a molecule capable of stimulating intratumoral Vd2 T lymphocytes such as a molecule selected from a phosphoantigen (such as bromohydrinpyrophosphate or BrHPP, Phosphostim®) and a lipid. Such a compensatory molecule is preferably used in combination with a conventional chemotherapeutic agent in particular in patients who do not correctly express IL-17.

The compensatory molecule may also be a molecule capable of promoting activation of costimulatory receptors (such as agonists CD40 Ab, CD27 Ab, 4-1BB Ab) or a molecule (for example an antibody) capable of blocking inhibitory pathways such as CTLA4, LAG3, Tim-3, PD-1, PDL1, BTLA4.

The compensatory molecule may more particularly be selected from an anti-allergic drug, in particular an anti-histaminic drug or an anti-inflammatory drug; a neurotropic drug, in particular an antidepressant drug, an antipsychotic drug, an antiparkinsonian drug, an anti-headache drug, an analgesic drug, an anticonvulsant drug and an immunosuppressive drug; an antihypertensive or cardiotropic drug such as a Na$^+$K$^+$ATPase inhibitor; a spindle poison drug such as an antineoplastic drug, an antimitotic drug and an antigout drug; an antimicrobial drug, in particular an anthelmintic drug, an amebicide drug, an antibacterial drug, an antifungal drug and an antimalarial drug; an anti-osteoclastic drug; a diuretic drug; an oestrogen; an apyrase inhibitor; and any combination thereof.

In particular embodiments of the present invention:
the anti-histaminic drug may be selected from antazoline phosphate, azelastine hydrochloride, brompheniramine maleate, cyclizine, cyproheptadine, ketotifene, fenspiride, loratadine and terfenadine.
the anti-inflammatory drug may be flunisolide.
the antidepressant drug may be selected from sertraline hydrochloride, paroxetine hydrochloride, mianserin hydrochloride, trazodone and mirtazapine.
the antipsychotic drug may be selected from ketanserin tartrate, risperidone, olanzapine, quetiapine fumarate, ziprasidone, clozapine, aripiprazole, haloperidol and perphenazine.
the antigout drug may be colchicine.
the antiparkinsonian drug may be selected from procyclidine hydrochloride and bromocriptine mesylate.
the anti-headache drug may be selected from methysergide maleate and pizotyline malate.
the analgesic drug may be carbamazepine.
the anticonvulsant drug may be carbamazepine.
the immunosuppressive drug may be rapamycin.
the antihypertensive or cardiotropic drug may be selected from atenolol, benazepril hydrochloride, amlodipine besylate and nimodipine.
the antineoplastic drug may be selected from MTX, DX, vinblastine sulphate and vincristine sulphate.
the antimitotic drug may be colchicine.
the amebicide drug may be diloxanide furoate.
the anthelmintic drug may be mebendazole.
the antibacterial drug may be selected from cycloserine
the antifungal drug may be fluconazole.
the antimalarial drug may be mefloquine.
the anti-osteoclastic drug may be etidronate disodium.
the diuretic drug may be bumetanide.
the oestrogen may be estrone.

the Na⁺K⁺ATPase inhibitor may be a cardiac glycoside such as digoxin, digitoxin, ouabain, proscillaridin, strophantin and sanguinarin.

the apyrase inhibitor may be a ecto-nucleoside-triphosphate-diphosphohydrolase (CD39) inhibitor (polyoxometalate 1), 6-N,N-Diethyl-D-beta-gamma-dibromomethylene adenosine triphosphate (ARL 67156), 2'(3')-O-(4-benzoylbenzoyl)-adenosine triphosphate, an antibody inhibiting the ecto-apyrase activity of CD39 and an antibody inhibiting the ecto-5'-nucleotidase activity.

The compensatory molecule may further be selected from an histamine H1 antagonist such as antazoline phosphate, azelastine hydrochloride, brompheniramine maleate, cyclizine, cyproheptadine, ketotifene, fenspiride, loratadine or terfenadine; a 5HT uptake inhibitor such as sertraline hydrochloride or paroxetine hydrochloride; a Ca channel blocker such as amlodipine besylate or nimodipine; a spindle poison such as colchicine, vinblastine sulphate or vincristine sulfate; a topoisomerase II inhibitor such as MTX or DX; a dopamine antagonist such as haloperidol; a dopamine and serotonin antagonist such as risperidone, olanzapine, or clozapine; a glucose uptake inhibitor such as mebendazole; an inhibitor of alanine racemase such as cycloserine; a norepinephrine reuptake inhibitor such as mianserin hydrochloride; an alpha2-adrenergic receptor antagonist such as mirtazapine; a ergosterol synthesis inhibitor such as fluconazole; a 5HT antagonist such as ketanserin tartrate, pizotyline lalate; a beta adrenergic blocker such as atenolol; a ACE inhibitor such as benazepril hydrochloride; a bone resorption inhibitor such as etidronate disodium; an anticholinergic such as benserazide hydrochloride, biperiden, carbidopa, cyclopentolate hydrochloride, dibucaine hydrochloride, dicyclomine hydrochloride, doxepin hydrochloride, ethopropazine hydrochloride, maprotiline hydrochloride, mepenzolate bromide, nortriptyline, protryptiline hydrochloride, oxybutynin chloride, procyclidine hydrochloride, pyrimethamine, quinidine gluconate, solifenacin, trimipramine maleate; a prolactine inhibitor such as bromocriptine mesylate; a FRAP inhibitor such as rapamycin, a steroid such as flunisolide; an adrenergic agonist such as adrenaline bitartrate, xylometazoline hydrochloride, naphazoline hydrochloride; and any combination thereof.

The compensatory molecule may further be selected from an acetamide, an alkaloid derived from periwinkle, an alkaloid derived from ergot, an anthracycline, a benzimidazole, a benzodiazepine, a butyrophenone, a dibenzoazepine, a dibenzocycloheptene, a dibenzodiazepine, a dihydropyridine, a diphosphonate, a phenylpiperidine, a propanol and a thiazole derivative.

A particular acetamide may be selected for example acetaminosalol, acetanilide, aminitrozol, bufexamac, citiolone, clofexamide chlorhydrate, clofezone, fenoxedil chlorhydrate, guanfacine chlorhydrate, lidocaine, lidocaine chlorhydrate, mefexamide chlorhydrate, oxetacaine, salicylate de picolamine, thiamphenicol, thiamphenicol aminoacetate acetylcysteinate, thiamphenicol aminoacetate chlorhydrate and valpromide.

A particular alkaloid derived from periwinkle may be selected from for example vindesine sulphate and vinorelbine ditartrate.

A particular alkaloid derived from ergot may be selected from for example lisuride maleate acide, methylergometrine maleate, methysergide maleate acide and nicergoline.

A particular anthracycline may be selected from for example aclarubicine chlorhydrate, daunorubicine chlorhydrate, epirubicine chlorhydrate, idarubicine chlorhydrate, pirarubicine and zorubicine chlorhydrate.

A particular benzimidazole may be selected from for example albendazole, astemizole, bendazol, benperidol, candesartan cilexetil, chlormidazole chlorhydrate, clemizole hexachlorophenate, clemizole penicilline, clemizole undecylenate, domperidone, flubendazole, lansoprazole, mibefradil dichlorhydrate, mizolastine, omeprazole, oxatomide, pantoprazole sodique, pimozide, rabeprazole sodique, telmisartan and tiabendazol.

A particular benzodiazepine may be selected from for example alprazolam, bromazepam, brotizolam, chlordiazepoxide, clobazam, clonazepam, clorazepate dipotassique, clotiazepam, cloxazolam, delorazepam, diazepam, estazolam, flunitrazepam, ketazolam, loflazepate d'ethyle, loprazolam mesilate, lorazepam, lormetazepam, medazepam, midazolam chlorhydrate, nitrazepam, nordazepam, oxazepam, pirenzepine dichlorhydrate, prazepam, temazepam, tetrazepam, tofisopam and triazolam.

A particular butyrophenone may be selected from for example benperidol, buflomedil chlorhydrate, droperidol, fluanisone, haloperidol decanoate, moperone chlorhydrate, pipamperone dichlorhydrate, primaperone chlorhydrate and trifluperidol chlorhydrate A particular dibenzoazepine may be selected from for example carpipramine dichlorhydrate, clomipramine chlorhydrate, desipramine chlorhydrate, imipramine chlorhydrate, metapramine fumarate, opipramol dichlorhydrate, prozapine chlorhydrate, quinupramine, trimipramine maleate and trimipramine mesilate.

A particular dibenzocycloheptene may be selected from for example amineptine chlorhydrate, amitriptyline, amitriptyline chlorhydrate, cyproheptadine chlorhydrate, demexiptiline chlorhydrate, nortriptyline chlorhydrate, noxiptiline chlorhydrate and protriptyline chlorhydrate.

A particular dibenzodiazepine may be selected from for example clozapine and dibenzepine chlorhydrate.

A particular dihydropyridine may be selected from for example felodipine, isradipine, lacidipine, nicardipine chlorhydrate, nifedipine and nitrendipine.

A particular diphosphonate may be selected from for example alendronate monosodique, clodronate disodique, ibandronate sodique, pamidronate disodique and tiludronate disodique.

A particular phenylpiperidine may be selected from for example remifentanil chlorhydrate and sufentanil.

A particular propanol may be selected from for example acranil, alprenolol chlorhydrate, bufeniode, buphenine chlorhydrate, bupranolol chlorhydrate, chlorobutanol, cimepanol, clofedanol, corbadrine chlorhydrate, cyclopentobarbital ephedrine, dimercaprol, dioxethedrine chlorhydrate, dioxyphedrine chlorhydrate, diphepanol, ephedrine, ephedrine chlorhydrate, ephedrine levulinate, ephedrine sulfate, fenalcomine chlorhydrate, ifenprodil tartrate, inosiplex, isoxsuprine chlorhydrate, metaraminol bitartrate, methoxamine chlorhydrate, metoprolol succinate, metoprolol tartrate, nadolol, ornidazole, oxprenolol chlorhydrate, penbutolol sulfate, phenylpropanolamine chlorhydrate, pindolol, pridinol chlorhydrate, pseudoephedrine chlorhydrate, pseudoephedrine sulfate, racephedrine chlorhydrate, ritodrine chlorhydrate, secnidazole, suloctidil, tertatolol chlorhydrate, trihexyphenidyle chlorhydrate, zipeprol and zipeprol dichlorhydrate A particular thiazole derivative may be selected from for example azathioprine, bifonazole, butoconazole nitrate, carbimazole, clotrimazole, dacarbazine, econazole nitrate, eprosartan mesilate, etomidate chlorhydrate, fenticonazole nitrate, histamine dichlorhydrate, imiquimod, isoconazole nitrate, ketoconazole, metronidazole, metronidazole benzoate, miconazole, miconazole nitrate, nimorazole, ondansetron chlorhydrate, ornidazole, oxiconazole nitrate, secnidazole, sertaconazole nitrate, sulconazole nitrate, thiamazole, tinidazole and tioconazole.

A further object of the present invention relates to the use of at least one compensatory molecule, from the molecules identified previously, to prepare a pharmaceutical composition that is preferably intended to be administered in combination with a distinct product. typically an agent used in a treatment of cancer, in particular in a conventional treatment of cancer as mentioned previously (for example a non immunogenic treatment), to prevent or treat a cancer as defined above, in a mammal, preferably a human.

In this context, the compensatory molecule can be considered as an adjuvant to the conventional therapeutic drug.

In a particular embodiment, if the patient having a tumor is to be exposed to an immunogenic conventional cancer treatment as previously defined, and if the tumor is identified, using a method as herein described, as not able to induce an anticancer immune response, then a compensatory product should be administered to the subject, preferably together with the first exposition, for example administration, of the immunogenic conventional cancer treatment (for example chemotherapeutic drug, ionizing radiation, etc.).

Such a compensatory product may be selected in particular from a recombinant CRT (rCRT) and a recombinant IL-8 (rIL-8).

In such a situation where the tumor is not able to induce an anticancer immune response, the compensatory product is preferably to be administered in the tumor or in the tumor bed.

In another particular embodiment, (i) if the patient having a tumor is to be exposed to an immunogenic conventional cancer treatment as previously defined, for example a chemotherapy using anthracyclines, (ii) if the tumor, for example a breast tumor, is identified, using a method as herein described, as able to induce an anticancer immune response, and (iii) if the subject is identified, using a method as herein described, as not able to induce an anticancer immune response, because, for example, of the presence of a SNP [as identified previously, in particular rs2066853 (SEQ ID NO: 7)] in her AHR gene, then a compensatory product should be administered to the subject, preferably with a conventional treatment of cancer.

In a preferred embodiment, the conventional treatment of cancer is a chemotherapy and the compensatory product is administered after each cycle of the all chemotherapeutic treatment, preferably two, three, four or five days after the exposition of the subject to a cycle of the chemotherapeutic treatment.

Such a compensatory product may be selected for example from IL-17 producing γδ T cells, phosphantigens such as biphosphonates (zoledronate) and clodronate.

In a particular embodiment of the present invention, the absence of IL-17 producing γδ T lymphocytes in the tumor of a subject or the presence of SNP in the genomic DNA of the subject (such as in the AHR or in the NLRP4 gene) for example, is indicative of the absence of an anticancer immune response in the subject who has been exposed to a conventional treatment of cancer, in particular to a chemotherapeutic treatment of cancer, and reveals a resistance of the subject to the treatment of cancer.

A compensatory product should thus be administered to this subject, preferably locally in the tumor, preferably together with the conventional treatment of cancer. Such a compensatory product may be selected from IL-17 producing γδ T lymphocytes; recombinant IL-22 (rIL-22) and/or IL-17 (rIL-17); phosphoantigenic synthetic ligands of γδ T lymphocytes [preferably together with recombinant IL-1b (rIL-1b) and/or IL-23 (rIL-23)], such as bromohydrin pyrophosphate (BrHPP, active pharmaceutical ingredient in Phosphostim) and Vδ2 T lymphocytes activators such as biphosphonates (zoledronate) and/or clodronate.

The previously mentioned compensatory products are preferably injected locally into the tumor or in a tumor bed.

Also herein provided, is a pharmaceutical composition comprising such a drug or compensatory molecule or a combination of identical or different drugs or compensatory molecules, in association with a pharmaceutically acceptable excipient or diluent.

Appropriate excipient, diluent or carrier usable in the all present invention may be selected for example from saline, isotonic, sterile or buffered solutions, etc. They can further comprise stabilizing, sweetening and/or surface-active agents, etc. They can be formulated in the form of ampoules, flasks, tablets, or capsules, by using techniques of galenic known per se.

The pharmaceutical composition mentioned previously may be administered to the subject in need thereof, before, during and/or after any treatment of cancer described previously. It is preferably administered during or after said treatment, for example 24 hours, two days, three days or four days after the treatment.

For example, in a particular embodiment of the present invention, the compensatory products are IL-17 producing γδ T lymphocytes which may be advantageously administered to a subject in need thereof, two days after exposition of said subject to a treatment of cancer using radiotherapy or a chemotherapy wherein, for example, DX is administered to the subject.

Also herein described are compensatory molecules for use in the treatment of cancer, preferably in combination with a conventional treatment of cancer, in particular a chemotherapeutic treatment of cancer, in a subject identified, by a method as herein described, as resistant to a conventional treatment of cancer.

Method to Prevent or Treat a Disease

The present invention also relates to a method for preventing or treating a cancer, as herein defined, comprising the administration to a mammal, in particular a human, in need thereof, of at least one compound selected from the previously described compensatory molecules, preferably together with (in combination with) a distinct therapeutic agent, typically an agent used in a conventional treatment of cancer as defined previously.

A subject in need of a compensatory molecule is subject that has been tested and identified as resistant to a treatment of cancer according to the method described above.

In a particular embodiment of the present invention, the previously described method for treating cancer is performed on a subject having a tumor before surgical resection thereof.

In another particular embodiment of the present invention, the previously described method for treating cancer is performed on a subject having a tumor after surgical resection thereof.

The above method to treat a disease may comprise a step of directly injecting at least one selected compensatory molecule in the tumour, or in the tumor bed, of the subject in need thereof.

Screening Methods

The present invention also provides a method for screening or selecting a compound that is able to modify the activity of the immune system towards a tumor cell, in particular to trigger an immunogenic tumor cell death, the method comprising a step of detecting and/or measuring the level of expression, by a particular tumor cell, of a functional immunogenic cell death-associated molecule as herein described, in the presence of a test compound, wherein a modified expression in comparison with a control cell that has not been exposed to or contacted with the test compound, is indicative of the capacity of said compound to modify the activity of the immune system towards said cell.

The present invention further provides a method for screening a compound usable for treating a cancer, as a compensatory product according to the present invention, in a subject having an altered nucleic acid, an altered nucleic acid expression, or an abnormal expression or activity of the protein corresponding to said nucleic acid, said method comprising determining in vitro, in vivo or ex vivo the ability of a test compound to (i) restore a functional expression of said altered or abnormal protein (ii) modulate (i.e., induce, increase, or decrease) the expression or activity of said protein, or (iii) modulate the expression or activity of a ligand of said protein.

The compounds identified with one of the herein described screening methods may be used, in the context of the present invention, as compensatory molecules.

Other characteristics and advantages of the invention are given in the following experimental section (with reference to FIGS. 1 to 46), which should be regarded as illustrative and not limiting the scope of the present application.

Experimental Part

Example 1

IL-1β-Dependent Contribution of IL-17 Producing γδT Cells in the Efficacy of Cytotoxic Anticancer Therapies By triggering an immunogenic cell death modality, some anticancer compounds including anthracyclines elicit tumor-specific IFN-γ producing CD8$^+$ T cells that are mandatory for therapeutic success. This adaptive immune response depends on IL-1β produced by DC confronted with or exposed to anthracycline treated tumor cells. Inventors analyzed the influence of immunogenic chemotherapy on the tumor microenvironment to identify inflammatory components which link innate and cognate immune responses. Inventors herein demonstrate that distinct subsets of γδ T lymphocytes (Vγ4$^+$ and Vγ6$^+$) colonized tumors, where they proliferate and become potent IL-17 producers upon chemotherapy. In the present experiment, IL-17A production by γδ T cells fully depended on the DC mediated IL-1β production and aryl hydrocarbon receptors also contributed to this process. In Vγ4/6$^{-/-}$ mice or in the absence of a functional IL-17/IL-17 receptor (IL-17R) pathway or upon blockade of AHR, the response to immunogenic cell death or the efficacy of chemotherapy was compromised. Conversely, adoptive transfer of γδ T cells increased the efficacy of anthracycline-based chemotherapy, under the condition that these cells express the IL-1R1. Therefore, IL-17 producing γδT cells or lymphocytes γδT17 cells) represent a novel link between cell death and cognate immunity during anticancer chemotherapy.

While the contribution of IFN-γ to tumor surveillance and anticancer immune responses is clearly established, that of the IL-17A/IL-17R signaling pathway remains controversial (Kryczek et al., 2009; Martin-Orozco et al., 2009; Wang et al., 2009). In tumor models where CD4$^+$ T cells are the source of IL-17, this cytokine promotes IL-6-mediated Stat3 activation, acting as a pro-tumorigenic trigger (Kortylewski et al., 2009; Wang et al., 2009). Thus, inventors supposed that IL-17 could be one of the factors that link chronic inflammation to cancer development. However, in adoptive transfer experiments, IL-17-producing CD8$^+$ T cells could reduce the volume of large established tumor, presumably by differentiation into long-lasting IFN-γ producers (Hinrichs et al., 2009). Therefore, the source and/or the targets of IL-17 must determine whether this cytokine enhances or reduces tumorigenesis. Interestingly, it appears that the production of IL-17 is strongly dependent on signaling via aromatic AHR, a ligand-activated transcription factor widely expressed in many tissues including lymphoid organs. In particular, Th17 cells and dendritic cells express high levels of AHR. Activation of AhR by yet elusive endogenous ligands markedly increased the proportions of Th17 cells and their production of IL-17 (Veldhoen et al., 2008). However, before the present invention it was unknown whether and how AHR impacts on anticancer immune responses at the level of IL-17 production.

Similarly, the contribution of γδT cells in tumor immunosurveillance is still elusive (Hayday, 2009). In humans, γδ 1 T cells have been shown to either mediate immunosuppressive activities (Peng et al., 2007) or to be associated with a reduced occurrence of cancers in transplanted patients bearing a CMV infection (Dechanet et al., 1999). In contrast, γδ 2 T cells can be activated by various synthetic ligands to produce Th1-like cytokines and exhibit cytotoxic functions against tumors (Kabelitz et al., 2007). Although various γδ T cell subsets have been reported to be able to produce IL-17 during microbial infection or autoimmune disorders of mice (O'Brien et al., 2009; Shibata et al., 2007), no data are available on the incidence and functional relevance of IL-17-producing γδ T cells in cancer. γδT17 cells have been reported to share most phenotypic markers with Th17 (expression of CCR6, RORγt, AHR, IL-23R, IL-17A, IL-22) (Martin et al., 2009). They depend upon TGF-β but not IL-23 or IL-6 for their generation and maintenance (Do et al.) and they were unrestricted by Vγ usage (although they were mostly Vγ2Vγ3 in the context of mycobacteria (Martin et al., 2009) and V74 in experimental autoimmune encephalitis (Sutton et al., 2009)). Recent work suggests that thymic selection does little to constrain γδ T cell antigen specificities, but instead determines their effector fate. When triggered through the T cell receptor, ligand-experienced cells make IFN-γ, whereas ligand-naïve γδT cells produce IL-17 (Jensen et al., 2008). It is herein demonstrated that a therapy-induced immunogenic cancer cell death which stimulates a therapeutic anti-cancer immune response influences the composition and the architecture of the immune infiltrate present in tumors, which in turn contributes to the control of residual tumor cells. Inventors herein show that, in response to an immunogenic chemotherapy with anthracyclines and OXP, an early infiltration by γδ T17 cells is a prerequisite for optimal colonization of tumor beds by CD8$^+$ T lymphocytes, eventually leading to tumor growth retardation or regression. Inventors demonstrate that DC producing IL-1β in response to dying tumor cells and AHR signaling determine and optimize IL-17 release by γδ T cells. Finally, they show that both γδ T cells and the IL-17/IL17 receptor signaling are required for inducing an optimal anticancer response of a subject undergoing a chemotherapy and that the adoptive transfer of γδ T17 cells increases the therapeutic efficacy of an anticancer chemotherapy.

Material and Methods

Mice.

Wild type C57bl/6 (H-2$^b$) and BALB/c (H-2$^d$) mice aged between 7-12 weeks were purchased from Harlan (Gannat, France). Nude mice were bred in the animal facility of IGR. TCR δ$^{-/-}$ (H-2$^b$), IL-1R1$^{-/-}$ (H-2$^b$) and IL-17Rα$^{-/-}$ (H-2$^b$)

mice were bred at CDTA, Orléans, France through BR and PP (as for TCR $\delta^{-/-}$). V$\gamma$4$\gamma$6$^{-/-}$ mice (H-2$^b$) were kindly provided by GM and KI. IL-23p19$^{-/-}$ (H-2$^b$) were kindly provided by FP. CD1d$^{-/-}$ and CCR6$^{-/-}$ (H-2$^b$) were bred at St Vincent de Paul Hospital AP-HP, Paris, France and provided by KB. The experimental protocols were approved by the Animal Care and Use Committee in the animal facility of Institut Gustave Roussy.

Cell Lines and Reagents.

CT26 (H-2$^d$) colon cancer, MCA205 sarcoma (H-2$^b$), TS/A mammalian cancer (H-2$^d$) and EL-4 thymoma (H-2$^b$) were cultured in RPMI1640 supplemented with 10% FBS, 2 mM L-glutamine, 100 IU/ml penicillin/streptomycin, 1 mM sodium pyruvate, 1 mM non-essential amino acids, and 10 mM HEPES at 37° C., 5% $CO_2$. All media were purchased from GIBCO, France. AHR antagonist CH223191 was from Calbiochem. Recombinant mouse interleukin-1$\beta$ (IL-1$\beta$), IL-23, IL-6, TGF-$\beta$ and IL-18 BPd/Fc were from R&D system. DX hydrochloride (D1515) and MTX dihydrochloride (M6545) were from Sigma Aldrich. Mouse IL-17, IL-1$\beta$ ELISA kits were purchased from eBioscience. Mouse IL-22, IL-23 ELISA kits were purchased from R&D system. Antibodies for CD45.2 (clone 104), CD3E (clone 145-2C11), CD4 (clone GK1.5), CD8$\alpha$ (clone 53-6.7), TCR $\delta$clone GL-3, CD69 (clone H1.2F3), IL-17A (clone TC11-18H10) or IFN-$\gamma$ (clone XMG1.2) for surface or intracellular staining were from BD bioscience or eBioscience. Neutralizing antibodies for IL-17 (MAB421), IFN-$\gamma$ (XMG1.2), CCL20 (MAB760), IL-23 (AF1619), IL-23R (MAB1686) and IL-6 (MAB406) were from R&D system. LIVE/DEAD Fixable Dead Cell Stain Kit, DiOC6(3) and DAPI were purchased from Molecular Probes, Invitrogen. CpG oligodeoxynucleotide (ODN) 1668 was from MWG Biotech AG.

Tumor Models and Chemo/Radiotherapy.

0.8 million MCA205 or CT26 or TS/A tumor cells were inoculated subcutaneously near the thigh into C57Bl/6 (H-2$^b$) or BALB/c (H-2$^d$) mice. Anthracyclines-based chemotherapy was performed in MCA205 and CT26 models by intratumoral injecting DX (2 mM, 50 µl) when tumors reached the size 25-40 mm$^2$. Radiotherapy was performed by local X-ray irradiation (10 Gy, RT250, Phillips) at the unshielded tumor area when TS/A tumor reached the size 40-60 mm$^2$.

Gene Expression Assays.

Tumors from mice either treated with DX or PBS were removed 8 days after treatment. Whole RNA was extracted using RNeasy Mini Kit, QIAGEN from pieces of tumor homogenates. 5 µg of RNA from each sample were reverse-transcribed using Quantitect Reverse Transcription Kit (QIAGEN). Gene expression assays were performed with TaqMan® 96 well Plates customized to test cytokines, chemokines as well as transcription factors using StepOnePlus™ Real-Time PCR System. PPIA was chosen as the endogenous control to perform normalization between different samples.

Tumor Dissection and Flow Cytometry.

Tumor burdens were carefully removed, cut into small pieces with scissors within digesting buffer (400 U/ml Collagenase IV and 150 U/ml DNase I in RPMI1640) and incubated for 30 min at 37° C. Single cell suspension was obtained by grinding the digested tissue and filtering through 70 µM cell strainer. After washing with PBS, cells were resuspended at 2×10$^7$/ml, blocked with 10 µg/ml anti-CD16/CD32 (eBioscience) in PBS containing 2% mouse serum for 5 min at 4° C. 2.5 µg/ml of antibodies were used for surface staining at 4° C., 30 min. LIVE/DEAD Fixable Dead Cell Stain Kit was used to distinguish live and dead cells. For intracellular staining, freshly isolated cells were treated with, 50 ng/ml PMA, 1 µg/ml ionomycin and Golgi-stop (BD Pharmingen), 4 hrs, 37° C. in RPMI containing 2% mouse serum (Janvier, France). Cells were then washed with PBS and stained with anti-IFN-$\gamma$ (PE-cy7) and anti-IL-17 (PE) using BD Cytofix/Cytoperm™ Kit following the instructions.

Protein Extraction.

Tumors were mechanically dissociated with lysis buffer (T-PER Tissue Protein Extraction Reagent, PIERCE) containing protease inhibitor (complete Mini EDTA-free, Roche). Tumor lysate was then centrifuged at 10000×g, 5 min, 4° C. to obtain supernatant.

Purification and Adoptive Transfer of $\gamma\delta$ T Cells.

Naïve C57Bl/6 mice aged between 8-10 weeks were sacrificed and the skin-draining lymph nodes (LNs) including inguinal, popliteal, superficial cervical, axillary and brachial LNs were collected. LNs were squeezed with tweezers gently in digesting buffer, kept at 37° C. for 20 min and then pass through 40 µM cell strainer to get single cell suspension. Dead cells were removed using Dead Cell Removal Kit (Miltenyi Biotec) before purifying $\gamma\delta$ T cells with TCR$\gamma/\delta^+$ T Cell Isolation Kit (Miltenyi Biotec). An autoMACS™ Separator was used with the recommended programs. Purity of this isolation normally reached 95%. The TCR $\delta^-$ CD3$^+$ cells fraction was also collected from the final separation step and was called 'non $\gamma\delta$ T' cells for some experiments. Day 2 after DX or PBS treatment, 2.5×10$^5$ cells were injected directly into the tumor with insulin syringes in adoptive transfer setting.

T Cell Priming and Tumor Vaccination.

EG7 cells were pretreated either with 5 µg/ml OXP or left untreated for 24 hrs, washed thoroughly and injected at 1 million/50 µl into the syngeneic mice foodpad. CpG/OVA (CpG (5 µg/mouse), OVA (1 mg/mouse)) and PBS injection were used as positive and negative controls. In some setting, neutralizing antibody (200 µg/mouse) for IL-17A or isotype control antibody was injected i.p. 5 days later, the popliteal lymph node cells were harvested, seeded in 96 well plate at 3×10$^5$/well and restimulated with 1 mg/ml OVA protein. IFN-$\gamma$ secretion was measured by OptEIA™ Mouse IFN-$\gamma$ ELISA kit (BD Bioscience). MCA205 cells were treated with 2 µM MTX for 18 hrs, washed thoroughly and injected into left flank subcutaneously at 0.3 million/mouse. PBS was used as control. Mice were rechallenged with 5×10$^4$ live MCA205 cells in the right flank 7 days later. Tumor growth was monitored every 2-3 days.

DC-Tumor Mixed Lymphocyte Cultures.

DC were propagated in Iscoves's medium (Sigma Aldrich) supplemented with J558 supernatant, 100 UI/ml Penicillin, 100 µg/ml Streptomycin, 2 mM L-glutamine, 50 µM 2-mercaptoethanol (Sigma), 10% heat-inactivated and filtered, 10% FCS and 40 ng/ml GM-CSF. DC were used between day 8 and 12 when the proportion of CD11c/MHC class II+ cells was >80%. In mixed cocultures, DC were seeded at 10$^5$/100 µl/well in U bottom 96 well plates. Tumor cells were treated with 25 µM DX or 2 µM MTX for 16 hrs, washed in PBS and added into these wells at 7.5×10$^5$/100 µl/well. 2×10$^4$/50 µl $\gamma\delta$ T cells were added into the wells 12 hrs later. Supernatant was collected 48 hrs later.

Statistical Analyses of Experimental Data.

All results are expressed as means±standard error of the mean (SEM) or as ranges when appropriate. For two groups, normal distributions were compared by Student's t test. Non-normal samplings were compared using the Mann-Whitney's test or Wilcoxon matched paired test when appropriate. The log-rank test was used for analysis of Kaplan-Meier survival curve. Statistical analyses were performed using Prism 5 software (GraphPad, San Diego, Calif.). P values of <0.05 were considered significant.

Results

Patterns of Cytokine/Chemokine Production Post-Chemotherapy

Anthracyclines induce immune responses that culminate in CD8+ T cell- and IFN-γ/IFN-γ R dependent antitumor effects (Ghiringhelli et al., 2009). To further study chemotherapy-induced immune effectors at the site of tumor retardation, inventors performed quantitative RT-PCR to compare the transcription profile of 40 immune gene products expressed in MCA205 tumors which were regressing in response to chemotherapy with the anthracycline DX 8 days post-treatment, with that of progressing tumors due to the absence of treatment (PBS control) (FIG. 1A). Several Th1-related gene products were specifically induced in regressing tumors (FIG. 1B). Thus, the Th1 transcription factors Eomes and Tbx21 (also called T-bet), as well as the end product IFN-γ, were increased 4-5 fold in doxorubicine (DX) versus PBS-treated tumors (FIG. 8A). Unsupervised hierarchical clustering indicates that IFN-γ production correlates with that of the transcription factor Tbx21, which is the quintessential Th1 transcription factor. By day 3-7, the protein levels of IFN-γ also increased in regressing MCA205 sarcoma (FIG. 1C). Other surrogate markers of Th1 responses (lymphotoxin-β, Ccl5, Cxcl10, Cxcl9, TNF-α) were also significantly induced at the mRNA level following anthracycline treatment (FIG. 1B). Unexpectedly, another set of gene products were also overexpressed in the context of anthracycline-induced tumor regression. These genes encoded IL-7R, IL-21, AHR, Cxcl2 and Foxp3, suggesting that inflammation and/or tissue repair took place in the tumor bed (FIG. 1B, FIG. 8A). Indeed, on days 3 to day 8 post-chemotherapy, the protein levels of the inflammatory cytokine IL-17 were significantly increased within tumor homogenates (FIG. 1C, right panel). Reenforcing this finding, we show that AHR, a sensor of small chemical compounds, is involved in the success of anthracyclines based therapy in this model. CH-223191 is a pure antagonist of AHR since it does not have any agonist actions up to 100 μM (Kim et al., 2006). Blocking AHR with CH-223191 markedly reduced the efficacy of DX on established cancers in vivo (FIG. 1D) although CH-223191 had no cell-autonomous effects on the tumor cells, alone or in combination with anthracyclines (FIG. 8B). Moreover, DX (compared with PBS) induced a 3-fold increase in the proportions of both IFN-γ and IL-17 producing tumor infiltrating lymphocytes (TILs) as tested by flow cytometry (FIG. 1E). All together, these data show that chemotherapy modify the chemokine/cytokine tumor microenvironment, leading to early Th17-geered inflammation together with a marked Th1 polarization.

γδ T Lymphocytes are the Major Source of IL-17 in Several Models of Anticancer Chemotherapy.

To identify the cellular source of IFN-γ and IL-17, TILs were immunophenotyped by a combination of cell surface staining and intracellular detection of the cytokines with flow cytometry. Careful analyses revealed that 8 days post-chemotherapy in MCA205 sarcomas, the major source of IFN-γ were CD8+ T cells, while that of IL-17 were mostly TCR δ+ T cells rather than CD4+ Th17 cells (FIG. 2A). Inventors further analyzed the IFN-γ and IL-17 production by each subset of TILs. It turned out that CD4+ T cells could produce IFN-γ and a small amount of IL-17 while CD8+ T and γδ T cells were polarized to become potent producers of IFN-γ and IL-17 respectively. Doxorubicin-based chemotherapy substantially enhanced IFN-γ production by CD8+ and CD4+ TILs as well as IL-17 production by γδ TILs (FIG. 2B) and induced a more intense infiltration of these cytokine producers (FIG. 2C). A kinetic study indicated that γδ TILs invade MCA205 tumor beds at early time points (FIG. 2D), rapidly divide (as indicated by the expression of Ki67) (FIG. 2E) and produce IL-17 shortly after chemotherapy, with significant increases over the background 4 days after anthracyline injection (FIG. 2D, left panel). This early induction of IL-17 contrasts with the comparatively late induction of IFN-γ production by CD8+ T cells, which emerged 8 days after chemotherapy (FIG. 2D, right panel).

To generalize these findings, inventors systematically immunophenotyped TILs in CT26 colon cancer treated by a single intratumoral injection of DX which significantly retarded tumor growth (FIG. 9A). Indeed, the majority of IL-17+ TILs were CD45+CD3$^{bright}$ cells and they failed to express CD4 but were positively stained with anti-TCR δ specific antibodies (FIG. 9B). Consistently, chemotherapy increased the frequency of IFN-γ producing CD8+ T lymphocytes (Tc1) (FIG. 9C) and IL-17-producing γδ T cells (γδ T17) (FIG. 9D) among TILs. Next, inventors monitored transplantable TS/A mammary carcinomas treated with local radiotherapy which operates in a T cell-dependent manner (Apetoh et al., 2007). Irradiation of TS/A tumors led either to tumor regression (TR) or to no response and hence tumor progression (TP) (FIG. 3A). An accumulation of both Tc1 (FIG. 3B) and γδ T17 (FIG. 3C) lymphocytes was found in those tumors that responded to radiotherapy, but not in those that continued to proliferate or in untreated controls. Importantly, in all three tumor models that were tested, a clear correlation was observed between invading γδ T17 and Tc1 cells in tumor beds (FIG. 2F, FIG. 3D, FIG. 9E). Thus, chemotherapy triggers the accumulation of cytokine producing TILs in the tumor bed. This applies to IFN-γ-producing CD8+ T cells, which have previously been shown to contribute to the chemotherapy-induced anticancer immune response (Ghiringhelli et al., 2009), as well as to IL-17-producing γδ T cells, which inventors decided to characterize at the functional level.

Most γδ T17 TILs had an effector memory phenotype which was preponderantly CD44+ CD62L- CD69+ granzyme B+. γδ T17 TILs did not express CD27, CD122, Scart 2 (a marker of γδ T17 cells residing in skin draining lymph nodes), CD24, c-kit or NKG2D (FIG. 10). Flow cytometry indicated that around 60% of tumor filtrating γδ T17 utilized Vγ4 chain (FIG. 10) but expression of Vγ1 and Vγ7 chain was rarely found (data not shown). We then sorted γδ T17 TILs which do not express Vγ1, Vγ4 or Vγ7 and performed single-cell PCRs (Boucontet et al., 2005) to examine their Vγ chain usage. These experiments revealed that 21 out of 23 clones contained a functional Vγ6 rearrangement identical to the one found in fetal γδ T cells, indicating that most γδ T17 TILs express either Vγ4 or Vγ6.

Inventors conclude that, during chemotherapy or radiotherapy-induced tumor regression, distinct subsets of γδ T cells accumulate in tumor beds and become γδ T17 cells, correlating with (and presumably preceding) the accumulation of Tc1 cells.

The IL-17/IL-17R Pathway is Involved in the Immunogenicity of Cell Death

Since both γδ T17 and Tc1 cells accumulated within tumors after chemotherapy or radiotherapy in a coordinated fashion, inventors determined whether neutralizing antibodies directed against their signature cytokines IL-17 and IFN-γ could mitigate the efficacy of anticancer therapies. The neutralization of either IFN-γ or IL-17 negatively affected the growth-retarding effect of DX against MCA205 tumors (FIG.

4A). Inventors have reported that specific anti-tumor immune response relies on CD8$^+$ T cells which could be primed by tumor cells undergoing immunogenic cell death and developed a system in which IFN-$\gamma$ production by OVA-specific T cells could be triggered by OXP-treated EG7 cells (Ghiringhelli et al., 2009). Inventors utilize this system to check whether IL-17 is involved in initiating the specific anti-tumor response, comparing normal wild type (WT) with IL-17R$\alpha^{-/-}$ mice. In this assay, the absence of IL-17R$\alpha$ fully abolished antigen-specific T cell priming in response to dying cells, yet had no negative effect to T cell priming by OVA holoprotein admixed with CpG oligodeoxynucleotides (FIG. 4B). Consistently, a neutralizing anti-IL-17A antibody (but not the isotype control antibody) markedly impaired the OVA-specific T cell response to OXP-treated EG7 cells (FIG. 4C). Since Th1/Tc1 immune responses against dying tumor cells mediate a prophylactic protection against a rechallenge with live tumor cells (Apetoh et al., 2007; Ghiringhelli et al., 2009), inventors addressed the functional relevance of IL-17/IL-17R$\alpha$ pathway in such a protective immunity. The subcutaneous injection of anthracycline mitoxanthrone (MTX) treated MCA205 sarcoma cells could protect WT mice (but not athymic nude mice) against rechallenge with live MCA205 tumor cells (FIG. 4D). The efficacy of this vaccination was attenuated in IL-17R$\alpha^{-/-}$ mice. Since IL-17 was not significantly produced by CD4$^+$ T cells, neither in the draining LN (not shown) nor in tumor beds during chemotherapy (FIG. 2A, 2B, FIG. 9B), they refrained from investigating Th17 cells and rather focused on $\gamma\delta$ T and NKT cells as potential IL-17 producers (Mills, 2008; Pichavant et al., 2008) that might contribute to the anticancer vaccination by dying tumor cells. While CD1d$^{-/-}$ mice, which lack NKT population (Godfrey et al., 2009), were undistinguishable from WT controls in their ability to protect themselves against the live tumor cells rechallenge after dying tumor cell vaccine, V$\gamma$4/6$^{-/-}$ mice (Sunaga et al., 1997) exhibited a reduced capacity to mount an anticancer immune response (FIG. 4D). These results suggest that IL-17, IL-17R, as well as $\gamma\delta$ T17 cells, all play an important role in the afferent phase of the immune response against dying tumor cells that includes T cell priming for IFN-$\gamma$ production.

$\gamma\delta$ T Lymphocytes are Indispensable for the Efficacy of Chemotherapy

To further evaluate the contribution of $\gamma\delta$ T cells to the therapeutic action of mitoxanthrone on established MCA205 sarcomas, such tumors were implanted in age and sex matched WT, TCR $\delta^{-/-}$, V$\gamma$4/6$^{-/-}$ and then subjected to systemic chemotherapy. As compared to wild type controls, the absence of the TCR $\delta$ chain, as well as V$\gamma$4 and V$\gamma$6 $\gamma\delta$ T cells greatly reduced the efficacy of chemotherapy (FIG. 5A).

Expression of CCR6 is a hallmark of Th17 cells at the phenotypic and functional (Reboldi et al., 2009) levels during some inflammatory processes. Inventors therefore analyzed the role of CCR6 in the efficacy of chemotherapy. Since CCL20 was abundant in tumor tissues post-chemotherapy (data not shown), they assessed whether $\gamma\delta$ T17 cells could be recruited in a CCL20/CCR6-dependent manner. The tumoricidal activity of DX against CT26 was not affected by repetitive systemic injections of neutralizing anti-CCL20 mAb before and during anthracyclines treatment (FIG. 5B). Consistently, anthracyclines treatment against established MCA205 sarcoma remained efficient in CCR6 loss-of-function mice (FIG. 5C). Moreover, CCR6 deficiency did not influence tumor infiltration by $\gamma\delta$ T17 (FIG. 11). Therefore, both V$\gamma$4/$\gamma$6 $\gamma\delta$ T cells and their effector molecular pathway IL-17/IL-17R are involved in the prophylactic and therapeutic efficacy of anticancer agents while CCR6 signaling seems to be indispensable for their colonization of tumor bed.

IL-1$\beta$-Dependent Activation of $\gamma\delta$ T Lymphocytes

To explore the molecular requirements for $\gamma\delta$ T17 cell activation in situ, inventors sorted $\gamma\delta$ T cells from the skin-draining lymph nodes (LNs) of naive mice (representing about 1% of the T cell pool contained in LN). Among these $\gamma\delta$ T cells, around 70% harbored the V$\gamma$4 TCR and they vigorously produced IL-17 (but not IFN-$\gamma$) upon stimulation with PMA/ionomycine (data not shown) (Do et al.). In contrast to Th17 cells (Ivanov et al., 2006), LN resident $\gamma\delta$ T cells failed to produce IL-17 in response to TGF-$\beta$ or IL-6, alone or in combination with IL-1$\beta$ (FIG. 6A). However, LN-resident $\gamma\delta$ T cells potently secreted IL-17A (and IL-22, not shown) in response to the combined stimulation with IL-1$\beta$ plus IL-23 (FIG. 6A). TCR engagement also synergized with IL-1$\beta$ (and to a lesser extent with IL-23) to trigger IL-17 secretion by LN-resident $\gamma\delta$ T cells (FIG. 6B). It is noteworthy that these stimuli specifically activated IL-17 (FIG. 6A, 6B) but not IFN-$\gamma$ production (data not shown) by $\gamma\delta$ T cells. Since V$\gamma$4$^+$ and V$\gamma$6$^+$ $\gamma\delta$ T cells were activated (as indicated by their Ki67$^+$, GzB$^+$, CD69$^+$, IL-17$^+$ phenotype) within tumor beds after chemotherapy, inventors addressed the question as to whether dying tumor cells could directly or indirectly (through myeloid antigen presenting cells) promote the activation of V$\gamma$4$^+$ and V$\gamma$6$^+$ T cells. Although doxorubicin-treated MCA205 cells failed to directly induce IL-17 (or IL-22, not shown) secretion by $\gamma\delta$ T cells, they did so indirectly. Thus, bone marrow-derived DC (DC) that had been loaded with doxorubicin-treated MCA205 cells (FIG. 6C) or CT26 cells (not shown) but not with live tumor cells markedly stimulated the release of IL-17 (and IL-22, not shown) by $\gamma\delta$ T cells (FIG. 6C). As a quality control for in vitro generated DC, the expression of CD11c, MHC class 11, CD11b and F4/80 was assessed. Only 'qualified' DC preparations that contain functional DC ($>$80% CD11c$^+$MHCII$^+$) rather than macrophages ($>$70% CD11b$^+$F4/80$^+$CD11c) can activate $\gamma\delta$ T cells for IL-17 production when they encountered DX treated tumor cells (data not shown).

Dying tumor cells (exposed to doxorubicin) but not live tumor cells could trigger IL-1$\beta$ production by DC (FIG. 6C and (Ghiringhelli et al., 2009)). The IL-17 production by $\gamma\delta$ T cells was dependent on IL-1$\beta$ since the IL-1R1/IL-1$\beta$antagonist IL-1RA entirely abrogated the DC/$\gamma\delta$ T cell cross-talk in the presence of dying cells while IL-1$\beta$ production was not modified (FIG. 6D). Blocking AHR could also hamper IL-17 production in this co-culture system. In contrast, neutralizing IL-23 or blocking IL-23R or blocking IL-18/IL-18R interaction failed to damp down the production of IL-17 (and IL-22, not shown) by the combination of DC, dying tumor cells and $\gamma\delta$ T cells (FIG. 6D). It is conceivable that the $\gamma\delta$ TCR might be engaged by an MHC class I-like molecule presented by DC because the IL-17 production by $\gamma\delta$ T cells was significantly improved by cell contact or a TCR cross-linking Indeed, the supernatants (containing at least IL-1$\beta$) of BMDCs loaded with dying cells could not entirely substitute for dying cell loaded DC in these in vitro assays (not shown). Blocking AHR markedly attenuated IL-17 production by $\gamma\delta$ T cells, both at the level of cytokine release (not shown) and on a per cell basis (FIG. 6E, left panel) in response to CD3 cross-linking and IL-1$\beta$ and/or IL-23, yet did not affect $\gamma\delta$ T cell viability (not shown) or their activation pattern (FIG. 6E, right panel).

Since inventors found that IL-1$\beta$ was required for the production of IL-17 by $\gamma\delta$ T cell in vitro, they assumed that $\gamma\delta$ T cells might be activated locally by this cytokine. Indeed, the adoptive transfer of $\gamma\delta$ T cells (instead of the non $\gamma\delta$ T cells purified from naïve skin LNs) into tumor beds two days post-DX ameliorated the efficacy of chemotherapy (FIG. 7A) while infusion of γδ T cells into non-treated tumors (failing to release IL-1β) could not control tumor outgrowth (FIG. 7A). However, when γδ T cells were derived from IL-1R1 loss-of-function mice, the synergistic antitumor effects of doxorubicine and adoptively transferred γδ T cells were lost (FIG. 7B), demonstrating the key role of endogenous IL-1β in driving the γδ T cell response.

Altogether, the present data indicate that chemotherapy-induced cell death stimulates DC to release IL-1β, which in turn is required for IL-17 production by γδ T cells. γδ T cells can act as enhancers of the immunological component of anticancer immune therapies, provided that they express the IL-1R.

Conclusions

Example 1 demonstrate a critical role for a subset of γδ T cells, particularly the Vγ4 and Vγ6-expressing subsets, which produce the effector cytokine IL-17, in the adaptive immune response against dying tumor cells which contributes to the efficacy of anthracycline-based conventional anticancer chemotherapy. Inventor demonstrate that the IL-17/IL-17Rα signalling pathway is required for the priming of IFN-γ-secreting antigen-specific T cells by tumor cells exposed to chemotherapy (FIG. 4B, 4C). This tumor-specific Tc1-mediated immune response is essential for the protective anticancer immunity that is triggered by immunization with dying tumor cells (FIG. 4D) because this protective immune response is lost in athymic nude mice (FIG. 4D) or when CD8+ T cells are depleted (Casares et al., 2005) or when the IFN-γ/IFN-γR system is blocked either by injection of neutralizing antibodies or knockout of IFN-γ (Ghiringhelli et al., 2009). Accordingly, inventors found that the absence of IL-17Rα reduced the capacity of mice to mount a protective immune response against dying tumor cells (FIG. 4D).

When exploring the source of IL-17 production elicited by dying tumor cells, inventors found that γδ T cells were the quantitatively and functionally most important IL-17 producers, based on several observations. First, in the context of anticancer chemotherapy, γδ T17 cells accumulated within tumors (FIG. 2B, 2C, 3C, FIG. 9D). Indeed, most IL-17 producing cells were positive for γδ T markers (FIG. 2A, FIG. 9B). Secondly, antigen-specific CD4+ T cells in lymph nodes (LNs) draining the dying tumor cells are polarized to a Th1 cytokine (IL-2 and IFN-γ) secretion pattern (Ghiringhelli et al., 2009) instead of a Th17 pattern (data not shown). Also, IL-6 and TGF-β, two key regulatory cytokines essential for the differentiation of Th17 cells (Ivanov et al., 2006) were dispensable for the efficacy of chemotherapy (FIG. 12A, 12B), suggesting that Th17 cells are not required for the anticancer immune response that amplify the effect of chemotherapy. Thirdly, when popliteal lymph nodes were recovered from mice that had been injected with dying (but not live) tumor cells through footpad, the re-stimulation of LN-resident cells using anti-CD3EAb+IL-23 readily enhanced IL-17 production (not shown), a feature common to memory T cells, especially innate NKT (Rachitskaya et al., 2008) and γδ T cells (Sutton et al., 2009) (FIG. 6B). Fourthly, the subset of NKT cell capable of producing IL-17 in LN(CD103+CD4− NK1.1−CCR6+ CD1d tetramer+) (Doisne et al., 2009) did not appear to be specifically triggered by dying cells in vivo (not shown). Moreover, CD1d−/− mice, which lack NKT cells, were indistinguishable from WT mice when the efficacy of chemotherapy was assessed in prophylactic vaccination settings (FIG. 4D). Finally, knockout Vγ4/6 or TCR δ attenuated the protective antitumor vaccination with dying tumor cells (FIG. 4D) and reduced the efficacy of the anthracycline-based chemotherapy on established tumors (FIG. 5A).

In the context of immune responses stimulated by dying cancer cells, it clearly appears that IL-1β, an inflammatory cytokine that is produced by dendritic cells (DC), plays a major role in stimulating IL-17 production and the anticancer function of γδ T cells. The key role of IL-1β in regulating γδ T cells function was shown by using IL-1RA in cocultures of DC/γδ T cells in the presence of dying tumor cells (FIG. 6D). Also, γδ T cells that lack IL-1R cannot amplify the tumoricidal action of anthracyclines as IL-1R expressing γδ T cells do (FIG. 7B). Interestingly, DC-mediated IL-1β secretion was also found mandatory for the polarization of CD8+ T cells towards a Tc1 pattern (Ghiringhelli et al., 2009). The herein provided results demonstrate the importance of DC, γδ T17 cells and Tc1 cells (IFN-γ producing CD8+ T lymphocytes) to favor optimal anticancer immune responses. Inventors noticed a strong correlation between γδ T17 and Tc1 cells post-chemotherapy in three different tumor models and the fact that the emergence of IL-17 production precedes that of IFN-γ production by Tumor Infiltrating Lymphocytes (TILs). It is well possible that besides helping developing Tc1 response, γδ T17 cells might enhance the chemoattraction of Tc1 effector cells into the tumor beds. These results are compatible with observations obtained in a cancer-unrelated context, microbial infection, in which γδ T17 associated with Th1 responses to exert protective immune response (Umemura et al., 2007). As IL-17 could not directly induce IFN-γ production or enhance proliferation of CD8+T cells (data not shown), the present results imply a causal relationship between the presence of γδ T17 cells and the recruitment of antitumor effector Tc1 cells into tumor beds.

Example 2

The Single-Nucleotide Polymorphism R554K (rs2066853) in AHR Gene Affects the Efficacy of Conventional Anti-Cancer Therapy in a Neoadjuvant Setting (Before Surgery) Breast Cancer Patients The inventors observed that the single-nucleotide polymorphism (SNP) R554K (rs2066853-SEQ ID NO: 7) in AHR gene (NCBI Reference Sequences: AHR genomic DNA: NC_000007.13 (SEQ ID NO: 1); AHR mRNA: NM_001621.3 (SEQ ID NO: 2)) affects the efficacy of conventional anti-cancer therapy in a neoadjuvant setting in breast cancer patients (n=239). Indeed, the proportion of pathological complete responses was higher in AHR wild-type group than in mutated group of patients treated with anthracyclines (24.3% in patients carrying the AHR normal allele versus 11.4% in patient with the R554K mutated allele; p=0.02 by Chi$^2$ analysis) (FIG. 13). In other words, the AHR R554K mutated allele enhanced the probability of relapse in patients treated with anthracyclines. Other AHR polymorphisms have the same predictive value, in particular the following AHR SNPs: rs10250822 (SEQ ID NO: 3), rs11505406 (SEQ ID NO: 4), rs1476080 (SEQ ID NO: 5), rs17779352 (SEQ ID NO: 6), rs2074113 (SEQ ID NO: 8), rs2158041 (SEQ ID NO: 9), rs2282885 (SEQ ID NO: 10), rs34938955 (SEQ ID NO: 11), rs35225673 (SEQ ID NO: 12), rs4986826 (SEQ ID NO: 13), rs713150 (SEQ ID NO: 14), rs7796976 (SEQ ID NO: 15), and rs7811989 (SEQ ID NO: 16).

The numbers and percentages of patients enrolled in the case-control study are displayed in a contingency table (Table 3) based on the primary endpoint (pathological complete response) and the genotype of AHR-R554K (rs2066853) SNP.

TABLE 3

|  | AHR-Arg554Lys mutated N (%) | AHR-Arg554Lys wild type N (%) |
| --- | --- | --- |
| No pathological complete response (No pCR) | 62 (88.6) | 128 (75.7) |
| Pathological complete response (pCR) | 8 (11.4) | 41 (24.3) |

Materials and Methods
Clinical Study Design

The inventors retrospectively constructed patient database using data obtained from Institut Gustave Roussy (France). All patients provided written informed consent for enrollment in the study. Eligible patients had histologically confirmed sporadic breast cancer. All patients received an anthracycline-based chemotherapy before surgery (FEC protocol in neoadjuvant setting). This study was based on a retrospective cohort (n=197—patients not treated with Herceptin) and a case-control cohort (n=42) matched for age, tumor grade and hormone receptors. The primary endpoint of the study was the pathogical complete response. After generation of the patient database and collection of genomic DNA samples, genotyping and statistical analyses were performed in a blinded fashion. A total of 239 patients fulfilled the inclusion criteria. Chi square test was used to compare the distribution of clinical characteristics across the two genotype groups. All analyses were carried out using SPSS software, version 16 (IBM SPSS Statistics, France).

Genotyping

DNA was isolated from frozen blood leukocytes from subjects. The TAQMAN Drug Metabolism Genotyping assay ID: C_11170747_20 was used to genotype the AHR G/A polymorphism (rs2066853). Briefly, 10 ng of genomic DNA was mixed with 5 µL of 2× TaqMan Genotyping Master Mix (Applied Biosystems) and 0.25 µL of 40× genotyping assay in a final volume of 10 µL. Temperature cycling and real time fluorescence measurement were done using an StepOnePlus System (Applied Biosystems). The genotypes were assigned to each subject, by comparing the signals from the two fluorescent probes, FAM and VIC, and calculating the −log(FAM/VIC) ratio for each data point with the StepOne software v2.0 (Applied Biosystems). The other AHR SNPs have been tested with the same procedure. Examples of the following TAQ-MAN Genotyping assays have been used: rs10250822 (SEQ ID NO: 3) (TAQMAN Genotyping assay ID: C_2541466_10), rs1476080 (SEQ ID NO: 5) (TAQMAN Genotyping assay ID: C_8302430_10), rs2282885 (SEQ ID NO: 10) (TAQMAN Genotyping assay ID: C_2541460_1_), rs2158041 (SEQ ID NO: 9) (TAQMAN Genotyping assay ID: C_2541454_30), rs713150 (SEQ ID NO: 14) (TAQMAN Genotyping assay ID: C_2541463_10), rs7796976 (SEQ ID NO: 15) (TAQMAN Genotyping assay ID: C_30633941_10), rs2074113 (SEQ ID NO: 8) (TAQMAN Genotyping assay ID: C_16163703_10), rs7811989 (SEQ ID NO: 16) (TAQMAN Genotyping assay ID: C_29150577_20) rs4986826 (SEQ ID NO: 13) (TAQMAN Genotyping assay ID: C_25650166_20), rs17779352 (SEQ ID NO: 6) (TAQMAN Genotyping assay ID: C_25650165_20).

Example 3

Restoration of the Immunogenicity of Cisplatin-Induced Cancer Cell Death

In this example, inventors specifically addressed the question why CDDP—in contrast to the related compound OXP—fails to induce immunogenic cell death. To address this question, they monitored several cell lines that express a series of cell death-relevant biosensors or biomarkers, allowing them to map the defect in the CRT exposure pathway elicited by CDDP. Furthermore, they designed a screening system allowing them to identify compounds that are inert with regard to apoptotic signalling, yet can restore CDDP's capacity to induce CRT exposure and to stimulate immunogenic cell death.

Materials and Methods
Reagents and Materials

Cell death was induced with MTX, CDDP (Sigma, Saint Louis, USA) or OXP (Sanofi-Aventis, Paris, France). Quinacrine and THAPS were purchased from Sigma. PeIF2a and eIF2a antibody has been purchased from cell signaling. Cell culture media and selection antibiotics were from Gibco.

Cell Culture

U2OS, 293FT and HeLa were cultured in DMEM medium supplemented with 10% (v/v) fetal calf serum, 1 mM sodium pyruvate and 10 mM Hepes buffer. CT26, Lewis lung cell carcinoma and MC205 cells were grown in RPMI supplemented with identical components. U2OS clones were selected with 1 mg/ml G418 (Gibco) or Zeocin or 5 µg/ml Blasticidine and stable clones were kept under 200 µg/ml or 1 µg/ml selection respectively.

Viral Transduction

Lentiviral particles for the transduction of cells with H2B-RFP have been produced in 293FT cells by means of the ViraPower lentiviral expression system (Invitrogen) following the manufacturer's instructions. For this purpose an H2B-RFP cDNA sequence has been cloned into the pLenti6 vector by means of the gateway system.

HT-CRT Stably Expressing U2OS Cells

The HaloTag® sequence was amplified from a pHT2 plasmid (Promega) as NotI restriction fragment with the STOP codon removed from the Halotag sequence. For the PCR amplification the following primers were used: Forward: 5'-AAGCGGCCGCAATGGGATCCGAAATCGGTAC-3' (SEQ ID NO: 453); Reverse: 5'-AAGCGGCCGCGCCGGC-CAGCCCGGGGAGCC-3' (SEQ ID NO: 454). PCR products were isolated on agarose gel, purified using the QIAquick Gel Extraction kit (Qiagen), and digested with the restriction enzyme NotI (Biolabs). The digested PCR product was ligated into the CRT-GFP plasmids at the NotI restriction site after removing the GFP sequence. Transfection of U2OS cells with the HaloTag®-CRT was carried out with Lipofectamine 2000 (Invitrogen) following the manufacturer's instructions. Stable clones stably were selected by means of Zeocin selection.

CRT-GFP, Bax-GFP; G3BP-GFP; GFP-LC3 Stably Expressing U2OS Cells

U2OS cells have been transfected by means of Lipofectamin 2000 following the manufacturers instruction with either CRT-GFP, Bax-GFP, G3BP-GFP or LC3-GFP cDNA. Subsequently the cells have been stably selected using G418 selection antibiotic (Gibco). Resistant cells have been single cell sorted with a FACSvantage cell sorter and GFP expressing clones have been selected. Some of the clones have further been stably transduced with lentiviral particles expressing H2B-RFP. These cells have again been single cell sorted to identify double fluorescent clones.

Compound Screen for CRT-Exposing Drugs Death Assays

One day prior to the experiment, $5 \times 10^3$ U2OS cells stably expressing CRT-GFP and H2B-RFP were seeded into 96-well Black/Clear Imaging Plates pre-treated with poly-L-lysine (BD Biosciences, San Jose, Calif., USA). The ICCB known bioactive compounds library (Enzo life science) (BML2840), comprising 480 distinct compounds, was added at a concentration range from 90 nM to 48 µM in the presence or absence of 50 µM CDDP. The cells were incubated for 4 h at 37° C. and subsequently fixed with 4% paraformaldehyde (PFA) for 20 min. After washing with PBS 4 viewfields per well were acquired by means of a BD pathway 855 automated microscope. The images were segmented and analyzed for GFP-granularity and nuclear shape area using the BD AttoVision software version 1.6 before data mining. The data was statistically evaluated using graph pad. To avoid inter plate variations the data has been intra plate normalized by calculating the ratio to untreated controls for each datapoint.

Cell Death Assays $6 \times 10^5$ U2OS cells were treated with the indicated cell death inducers for 16 h at the indicated concentration. Cell death was quantified by cytofluorometric analysis using a FACS Vantage (Becton Dickinson, Mountain View, USA) as described previously (REF). Thus, cells were stained with 40 nM 3,3 dihexyloxacarbocyanine iodide ($DiOC_6(3)$; Molecular Probes, Eugene, Oreg., USA) for 30 min at 37° C. and concomitantly with 1 µg/ml propidium iodide (PI; Sigma Aldrich) for 30 min at 37° C. to determine the mitochondrial transmembrane potential. Data were statistically evaluated using CellQuest Pro software (Becton Dickinson, Mountain View, USA).

Quinacrine Immunofluorescence

U2OS cells were treated with the indicated cell death inducers for 16 h at the indicated concentrations. Subsequently, cells were labeled with quinacrine as described previously (Martins et al., 2009). In short, cells were labeled with 1 µM quinacrine in Krebs-Ringer solution (125 mM NaCl, 5 mM KCl, 1 mM $MgSO_4$, 0.7 mM $KH_2PO_4$, 2 mM $CaCl_2$, 6 mM glucose and 25 mM Hepes, pH 7.4) for 30 min at 37° C. Thereafter, cells were stained with 1 µg/ml PI (Invitrogen) and 1 µg/ml Hoechst 33342 (Invitrogen) for 10 min, rinsed with Krebs-Ringer solution and fixed with 2% paraformaldehyde for 15 min at room temperature. Cells were examined with a BD Pathway™ 435 High-Content BioImager workstation (Becton Dickinson, Mountain View, USA) by using an UApo/340×20/0.75 objective (Olympus, Tokyo, Japan).

Quinacrine Flow Cytometry $6 \times 10^5$ U2OS cells were treated with the cell death inducers for 24 h. After incubation in quinacrine solution (as described above), cells were rinsed and resuspended in PBS containing 1 µg/ml PI. The samples were analyzed by means of a FACS Vantage (Becton Dickinson) and the data was statistically evaluated using the CellQuest Pro software (BD Biosciences).

ATP Release Assays

After cell death induction, extracellular ATP was measured by luciferin-based ENLITEN ATP Assay (Promega, Madison, USA) following the manufacturer's instructions. Intracellular ATP was measured using an ATP Assay kit (Calbiochem, Darmstadt, Germany) based on luciferin-luciferase conversion following the manufacturer's instructions. For assessment of the chemoluminescent signal, the plates were read in a Fluostar luminometer (BMG Labtech).

Analysis of Surface Exposed CRT

Cells were treated with the indicated agents for 4 hours and the day after they were collected. For the HaloTag® staining, cells were incubated for 30 min with HaloTag® Alexa Fluor® 488 Ligand, diluted in DMEM medium containing 10% of fetal bovine serum. Then cells were washed and incubated in DMEM medium for 30 min. Thereafter, cells were rinsed with PBS and stained with 1 µg/ml PI (Invitrogen). For CRT immune staining, cells were washed twice with PBS and fixed in 0.25% paraformaldehyde in PBS for 5 min. After washing again twice in cold PBS, cells were incubated for 30 min with primary antibody, diluted in cold blocking buffer (2% fetal bovine serum in PBS), followed by washing and incubation with the Alexa488-conjugated monoclonal secondary antibody in a blocking buffer (for 30 min). Each sample was then analyzed by FACScan (Becton-Dickinson) to identify cell surface CRT. Isotype-matched IgG antibodies were used as controls, and the fluorescent intensity of stained cells was gated on PI-negative cells. The same staining procedure was applied to U2OS CRT-GFP expressing cells grown on coverslips using an Alexa546 coupled secondary antibody before analysis in a Leica TCS SPE confocal microscope (Leica Microsystems, Wetzlar, Germany).

In Vivo Anti-Tumor Vaccination $1 \times 10^6$ MCA205 cells, untreated or treated with either OXP, CDDP were injected subcutaneously into 6-week-old female C57BL/6 mice (Janvier, Charles River) into the lower flank, whereas $5 \times 10^5$ untreated control cells were inoculated into the contralateral flank 6 days later (Casares et al., 2005). Tumor growth was evaluated for at least 50 days. All animals were maintained in specific pathogen-free conditions, and all experiments were carried out according to the Federation of European Laboratory Animal Science Association guidelines.

The Ethics Committee of Institut Gustave Roussy approved all the animal experiments.

Results

Failure of Cisplatin to Induce Calreticulin (CRT) Redistribution from the Endoplasmic Reticulum (ER) Lumen to the Cell Surface.

To monitor the redistribution of CRT from the ER lumen to peripheral locations close to plasma membrane, inventors generated U2OS cells that stably express a CRT-GFP fusion protein (Snapp et al., 2006). Control experiments revealed that this protein was located in the ER lumen, where most of the endogenous CRT resides (not shown). Upon treatment with mitoxanthrone (MTX) or OXP, two immunogenic cell death inducers, CRT-GFP relocates from a preponderantly perinuclear near-to-diffuse location (which is seen in untreated control cells) to a more peripheral granular distribution (FIG. 14A). This increased "granularity", which can be quantified using morphometric image analysis software {Rello-Varona, 2010 #37}, is only observed after treatment of the cells with MTX or OXP, but not after treatment with CDDP (FIG. 14A,B). Nonetheless, CDDP was able to induce chromatin condensation, the morphological hallmark of apoptosis as efficiently as MTX or OXP (percentage values in FIG. 14B). Indeed, pairwise comparisons were always performed at the $IC_{50}$ of both agents, which was ~600 µM for OXP and ~150 µM for CDDP in short-term experiments measuring imminent cell death (as indicated by a loss of the mitochondrial transmembrane potential, $\Delta\Psi_m$, see below). Surface immunofluorescence staining of CRT (revealed in red) confirmed that a few of the OXP-elicited CRT-GFP granules that were close to the cell surface, actually extruded CRT, which became accessible to a CRT-specific antibody. Again, no immunodetectable CRT was found on the surface of non-permeabilized cells treated with CDDP (FIG. 14 C).

Immunofluorescence detection of CRT requires several washing steps that might perturb the integrity of cells. To avoid this problem, inventors generated a chimeric protein that contains CRT in its N-terminus and the HaloTag® moiety in its C-terminus followed by the KDEL endoplasmic reticulum retention signal (FIG. 14D). This construct can be detected with commercially available HaloTag® ligands, which are either cell-permeable (as exemplified by HaloTag® Alexa Fluor® 488, green fluorescence) or cell-impermeable (as exemplified by HaloTag® TMR Ligand, red fluorescence) (FIG. 14E). The CRT-HaloTag® fusion protein underwent a similar intracellular redistribution (detected by staining with HaloTag® Alexa Fluor® 488) as did CRT-GFP when the cells were treated with MTX (not shown) or OXP. Moreover, U2OS cells expressing the CRT-HaloTag® fusion protein did not stain with the cell-impermeable HaloTag® ligand, unless they were treated with immunogenic cell death inducers such as OXP (FIG. 14F). Again, CDDP failed to induce the surface exposure of CRT-HaloTag®, as determined by fluorescence microscopy (FIG. 14F) or cytofluorometric analysis of HaloTag® TMR Ligand-stained cells (FIG. 14G).

In conclusion, CDDP is unable to induce CRT exposure in conditions in which it does induce nuclear apoptosis.

Failure of Cisplatin to Elicit ER Stress.

When used at their $IC_{50}$, CDDP and OXP had a comparable potency in inducing nuclear apoptosis (not shown). Moreover, both agents were able to induce mitochondrial perturbations that were assessed by two different methods. First, inventors determined the A11c, dissipation by means of the $\Delta\Psi_m$-sensitive fluorochrome $DiOC_6(3)$ (FIG. 15A,B). Second, they measured the relocation of a Bax-GFP fusion protein (von Haefen et al., 2004) from a diffuse to a punctate (presumably mitochondrial) pattern (FIG. 15C,D). Both CDDP and OXP induced similar mitochondrial perturbations (FIG. 15).

Moreover, both agents induced a similar release of ATP, which is one of the obligatory signals linked to immunogenic cell death (Ghiringhelli et al., 2009). This result was obtained using two different methods, namely staining of the cells with the ATP-sensitive fluorochrome quinacrine (FIG. 15A,B), or by measuring the residual ATP content within the cells (FIG. 16C) or the ATP secreted into the supernatant by means of a luciferase-based assay (FIG. 16D). Thus, both agents lead to similar perturbations in energy metabolism.

However, OXP and CDDP ware rather different in their capacity to elicit the redistribution of G3BP-GFP (Tourriere et al., 2003) or LC3-GFP (Kabeya et al., 2000) from a diffuse to a punctiform distribution, which indicates the formation of stress granules (FIG. 17A,B) or of autophagosomes (FIG. 17C,D), respectively. This difference was particularly remarkable at early time points. The formation of stress granules and autophagosomes is subordinated to the mandatory phosphorylation of eIF2α, which is also required for the redistribution of CRT to the cell surface (Obeid et al., 2007b). Indeed, OXP was much more efficient than CDDP in inducing eIF2a phosphorylation on serine 51, as determined by means of a phospho-neoepitope-specific antibody (FIG. 17E). Accordingly, the activating phosphorylation of PERK, the principal eIF2a kinase elicited by chemotherapeutic agents (Panaretakis et al., 2009), was detectable shortly after treatment with OXP but not CDDP (FIG. 17E). Altogether, these results suggest that CDDP is much less efficient in inducing an ER stress response than OXP.

Identification of Thapsigargin as an Agent that Reestablishes CRT Relocalization in Response to Cisplatin.

To identify compounds that might restore the defective CRT exposure pathway in tumor cells responding to CDDP, inventors conducted a high-content screen. This screen was based on the utilization of the ICCB library whose 480 components were individually tested for their capacity to stimulate the redistribution of CRT-GFP in U2OS cells that were either left untreated (not shown) or cultured for 4 h in the presence of 150 μM CDDP (FIG. 18A). When the results obtained in the absence and in the presence of CDDP were plotted for each compound individually, one single agent, THAPS, was identified as being particularly efficient in inducing CRT-GFP granularity in the presence (but not in the absence) of CDDP (FIG. 18B). This result was confirmed in several independent determinations on U2OS cells expressing CRT-GFP (FIG. 18C,D). Moreover, THAPS was capable of inducing the redistribution of CRT-HaloTag® (FIG. 19A), as well as that of endogenous CRT (FIG. 19B), as determined using the cell-impermeable CRT-HaloTag® ligand or antibodies recognizing CRT, respectively. While THAPS alone (in the absence of CDDP) was comparably inefficient in inducing CRT-GFP granularity (FIG. 18D), CRT-HaloTag® exposure (FIG. 19A) or native CRT exposure (FIG. 19B), it was highly efficient in the presence of CDDP. Very similar results were obtained in additional cell lines, including human cervical carcinoma HeLa cells (not shown), mouse Lewis lung carcinoma cells (FIG. 19F), colorectal carcinoma CT26 cells (FIG. 19D), and methylcholanthrene-induced MCA205 fibrosarcoma cells (FIG. 19E). Of note, THAPS exhibited no major cytotoxic effects and did not increase the toxicity of CDDP in any of these cellular models, as exemplified for U2OS cells in which inventors monitored $\Delta\Psi_m$ (FIG. 20A), intracellular ATP content (FIG. 20B,C,D) and extracellular ATP release (FIG. 20E). Confirming the strong correlation between CRT exposure and immunogenicity, CDDP-treated MCA204 cells were inefficient in inducing a protective anticancer immune response when injected subcutaneously into immunocompetent B6B157 mice one week before rechallenge with live tumor cells, in conditions in which OXP-treated MCA205 cells readily induce such a tumor-protective response (which precludes the growth of live MCA205 cells). However, the vaccine of dying cells, generated in the presence of CDDP combined with THAPS, elicited an effective anticancer immune response in vivo (FIG. 19F).

In conclusion, THAPS can reestablish the defective CRT exposure and associated immunogenicity of CDDP-induced cell death.

Conclusions

In contrast to other cytotoxic agents including anthracyclins and OXP, CDDP fails to induce immunogenic tumor cell death that would allow the stimulation of an anticancer immune response and hence amplify its therapeutic efficacy. This failure to induce immunogenic cell death can be attributed to CDDP's incapacity to elicit the translocation of CRT from the lumen of the ER to the cell surface. The previous results show that, in contrast to OXP, CDDP is unable to activate the protein kinase-like ER kinase (PERK)-dependent phosphorylation of the eukaryotic translation initiation factor 2α (eIF2α). Accordingly, CDDP also failed to stimulate the formation of stress granules and macroautophagy, two processes that only occur after eIF2α phosphorylation. Using a screening method allowing the following of the voyage of CRT from the ER lumen to the cell surface, inventors identified in particular THAPS, an inhibitor of the sarco/endoplasmic reticulum Ca(2+) ATPase (SERCA) as a molecule that on its own does not stimulate CRT exposure, yet endows CDDP with the capacity to do so. Such a molecule is identified, in the context of the present invention, as a compensatory molecule. Thus, the combination of THAPS and CDDP effectively induced the translocation of CRT to the plasma membrane, as well as immunogenic cell death, while each agent alone was inefficient. Altogether, these results underscore the contribution of the ER stress response to the immunogenicity of cell death, in particular the ER $Ca^{2+}$ fluxes for the translocation of CRT to the cell surface.

This experiment also allowed the identification of other compensatory molecules (in particular microtubules destabilizers), identified in the description part, which are also able to induce an immunogenic cell death.

Example 4

Restoration of the Immunogenicity of Conventional Treatment-Induced Cancer Cell Death The protocol described in example 3 has been applied in example 4 to screen other compounds (FIG. 21) from the US drug collection library from MS discovery (US 090917A). These compounds have been screened at 1 µM.

Inventors analyzed the capacity of the drugs to induce immunogenic cell death or to render the per se non immunogenic anticancer agent mitomycin C immunogenic. To address this question, they generated several cell lines that express a series of cell death- or cell stress-relevant biomarkers. This screening system enabled the identification of compounds that can restore or confer the capacity to induce ER stress-dependent CRT exposure, autophagy-dependent ATP release as well as cell death-dependent HMGB1 release and thereby stimulate immunogenic cell death.

Materials and Methods
Reagents and Materials

Cell death was induced with MTX, MitoC (Sigma, Saint Louis, USA). Quinacrine, digoxin, digitoxin, Ouabain, strophantin, proscillaridin, sanguinarine, DAPI, Hoechst 33342, NAC and GSH were purchased from Sigma. Anti-CRT antibody has been purchased from Abcam and Annexin-FITC from Becton Dickinson. Cell culture media and selection antibiotics were from Gibco.

Cell Culture

U2OS and 293FT were cultured in DMEM medium supplemented with 10% (v/v) fetal calf serum, 1 mM sodium pyruvate and 10 mM Hepes buffer. MCA205 cells were grown in RPMI supplemented with identical components. U2OS clones were selected with 1 mg/ml G418 (Gibco) or Zeocin or 5 µg/ml Blasticidine and stable clones were kept under 200 µg/ml or 1 µg/ml selection respectively.

Viral Transduction

Lentiviral particles for the transduction of cells with H2B-RFP have been produced in 293FT cells by means of the ViraPower lentiviral expression system (Invitrogen) following the manufacturer's instructions. For this purpose an H2B-RFP cDNA sequence has been cloned into the pLenti6 vector by means of the gateway system.

HMGB1-GFP Stably Expressing U2OS Cells

U2OS cells have been transfected by means of Lipofectamin 2000 following the manufacturers instruction with either HMGB1-GFP cDNA. Subsequently the cells have been stably selected using G418 selection antibiotic (Gibco). Resistant cells have been single cell sorted with a FACSvantage cell sorter and GFP expressing clones have been selected. The clones have further been stably transduced with lentiviral particles expressing H2B-RFP. These cells have again been single cell sorted to identify double fluorescent clones.

Screen for CRT-Exposition Inducing Drugs

One day prior to the experiment, $5 \times 10^3$ U2OS cells stably expressing CRT-GFP and H2B-RFP were seeded into 96-well Black/Clear Imaging Plates pre-treated with poly-L-lysine (BD Biosciences, San Jose, Calif., USA). The US Drug library (Microsource discovery) (US 090917A), comprising 1280 components, was added at a concentration range from 90 nM to 48 µM in the presence or absence of 50 µM CDDP. The cells were incubated for 4 h at 37° C. and subsequently fixed with 4% paraformaldehyde (PFA) for 20 min. After washing with PBS 4 viewfields per well were acquired by means of a BD pathway 855 automated microscope. The images were segmented and analyzed for GFP-granularity and nuclear shape area using the BD AttoVision software version 1.6 before data mining. The data was statistically evaluated using graph pad. To avoid inter plate variations the data has been intra plate normalized by calculating the ratio to untreated controls for each datapoint.

CRT-Exposition Inducing, and ATP-, HMGB1-Releasing Drugs Death Assays

One day prior to the experiment, $5 \times 10^3$ U2OS cells stably expressing CRT-GFP and H2B-RFP, HMGB1-GFP and H2B-RFP or WT cells were seeded into 96-well Black/Clear Imaging Plates pre-treated with poly-L-lysine (BD Biosciences, San Jose, Calif., USA). The US Drug library (Microsource discovery; US 090917A), comprising 1280 drugs that have reached clinical trial stages in the USA, was used at a concentration of 1 µM. CRT-GFP expressing cells were incubated for 4 h and HMGB1-GFP cell for 24 h at 37° C. and subsequently fixed with 4% paraformaldehyde (PFA) for 20 min. WT cells were incubate for 16 h before staining with quinacrine (see below). After washing with PBS 4 viewfields per well were acquired by means of a BD pathway 855 automated microscope. The images were segmented and analyzed for GFP-granularity, HMGB1-GFP nuclear intensity and quinacrine cytoplasmic granularity in addition the nuclear shape area was analyzed as a marker for apoptosis using the BD AttoVision software version 1.6 before data mining. The data was statistically evaluated using graph pad. To avoid inter plate variations the data has been intra plate normalized by calculating the ratio to untreated controls for each datapoint.

Cell Death Assays $6 \times 10^5$ U2OS cells were treated with the indicated cell death inducers for 16 h at the indicated concentration. Cell death was quantified by cytofluorometric analysis using a FACS Vantage (Becton Dickinson, Mountain View, USA) upon Annexin/DAPI costaining according to the manufacturer's instruction. Data were statistically evaluated using CellQuest Pro software (Becton Dickinson, Mountain View, USA).

Quinacrine Immunofluorescence

U2OS cells were treated with the indicated cell death inducers or compound library for 16 h at the indicated concentrations. Subsequently, cells were labeled with quinacrine as described previously (Martins et al., 2009). In short, cells were labeled with 1 µM quinacrine in Krebs-Ringer solution (125 mM NaCl, 5 mM KCl, 1 mM $MgSO_4$, 0.7 mM $KH_2PO_4$, 2 mM $CaCl_2$, 6 mM glucose and 25 mM Hepes, pH 7.4) for 30 min at 37° C. Thereafter, cells were stained with 1 µg/ml PI (Invitrogen) and 1 µg/ml Hoechst 33342 (Invitrogen) for 10 min, rinsed with Krebs-Ringer solution and fixed with 2% paraformaldehyde for 15 min at room temperature. Cells were examined with a BD Pathway™ 435 or 855 High-Content BioImager workstation (Becton Dickinson, Mountain View, USA) by using an UApo/340×20/0.75 objective (Olympus, Tokyo, Japan).

Quinacrine Flow Cytometry $6 \times 10^5$ U2OS cells were treated with the cell death inducers for 24 h. After incubation in quinacrine solution (as described above), cells were rinsed and resuspended in PBS containing 1 µg/ml PI. The samples were analyzed by means of a FACS Vantage (Becton Dickinson) and the data was statistically evaluated using the CellQuest Pro software (BD Biosciences).

ATP Release Assays

After cell death induction, extracellular ATP was measured by luciferin-based ENLITEN ATP Assay (Promega, Madison, USA) following the manufacturer's instructions. Intracellular ATP was measured using an ATP Assay kit (Calbiochem, Darmstadt, Germany) based on luciferin-luciferase conversion following the manufacturer's instructions. For assessment of the chemoluminescent signal, the plates were read in a Fluostar luminometer (BMG Labtech).

Analysis of Surface Exposed CRT

For CRT immune staining, cells were washed twice with PBS and fixed in 0.25% paraformaldehyde in PBS for 5 min. After washing again twice in cold PBS, cells were incubated for 30 min with primary antibody, diluted in cold blocking buffer (2% fetal bovine serum in PBS), followed by washing and incubation with the Alexa488-conjugated monoclonal secondary antibody in a blocking buffer (for 30 min). Each sample was then analyzed by FACScan (Becton-Dickinson) to identify cell surface CRT. Isotype-matched IgG antibodies were used as controls, and the fluorescent intensity of stained cells was gated on PI-negative cells. The same staining procedure was applied to U2OS CRT-GFP expressing cells grown on coverslips using an Alexa546 coupled secondary antibody before analysis in a Leica TCS SPE confocal microscope (Leica Microsystems, Wetzlar, Germany).

In Vivo Anti-Tumor Vaccination $1 \times 10^6$ MCA205 cells, untreated or treated with either OXP, CDDP were injected subcutaneously into 6-week-old female C57BL/6 mice (Janvier, Charles River) into the lower flank, whereas $5 \times 10^5$ untreated control cells were inoculated into the contralateral flank 6 days later (Casares et al., 2005). Tumor growth was evaluated for at least 50 days. All animals were maintained in specific pathogen-free conditions, and all experiments were carried out according to the Federation of European Laboratory Animal Science Association guidelines.

The Ethics Committee of Institut Gustave Roussy approved all the animal experiments.

HMGB1 Release ELISA

U2OS cells were seeded in 6 well plates 24 h before the experiment. The medium was changed to fresh DMEM before the treatment was applied. Supernatants were collected at 24 h post treatment, dying tumor cells were removed by centrifugation and supernatants were collected and shock frozen in liquid nitrogen. Quantification of HMGB1 in the collected supernatants was performed by enzyme-linked immunosorbent assay according to the manufacturer's instructions.

Retrospective Clinical Study

We retrospectively constructed a patient database using data obtained from Institut Gustave Roussy. The patients were divided into the digoxin receiving and into the control group. For each digoxin receiving patient two control patients with identical tumor grade and chemotherapeutic treatment have been chosen. All digoxin receiving patients were treated with digoxin while receiving chemotherapy. Age at diagnosis, pathological tumor size, lymph node involvement, tumor grade, hormone receptors, endocrine treatments, occurrence of events and follow-up were extracted from medical files and recorded in the database. After generation of the patient database statistical analyses were performed in a blinded fashion. Survival rates were estimated using the Kaplan-Meier method.

Results

Cardiac Glycosides as Potent Inducers of CRT Exposure, and HMGB1 and ATP Emission.

To identify compounds that might evoke immunogenic cell death or restore the defective immunogenic cell death pathways in tumor cells responding to non immunogenic anticancer drugs, inventors conducted a high-content screen. This screen was based on the use of the US Drug library whose 1280 components were individually tested for their capacity to stimulate the redistribution of CRT-GFP (Martins et al., 2010), the release of HMGB1-GFP (Kepp et al., 2011) or the release of ATP, monitored by quinacrine staining in U2OS cells (Martins et al., 2010). The obtained results were normalized and rank scored to depict the drugs that are most potent in emitting CRT, HMGB1 and ATP (FIG. 28A). When plotted the result revealed, apart from the expected anthracyclins doxorubicin, epirubicin and mitoxanthrone, a functional clustering of Na/K-ATPase inhibitors most pronounce agents of the cardiac glycosides (CG) family as being most potent in exposing CRT, and emitting HMGB1 and ATP.

CRT-GFP redistribution as a surrogate marker for CRT-exposure was validated by means of a cluster analysis in which untreated control, MTX or CG treated CRT-GFP cells were additionally stained with anti-CRT and secondary Alexa546-labeled antibody. A minimum of 500 cells was analysed and increased CRT-GFP redistribution and CRT surface staining was scored. In most of all cases the treated cells displayed the phenotype of CRT-GFP redistribution together with CRT exposure (FIGS. 28 B and C) validating the chosen screening model. The exposure of CRT was strongly dependent of reactive oxygen species as the antioxidants NAC and GSH significantly diminished CRT exposure upon Digoxin and Digitoxin treatment (FIG. 28E), which indicates that CGs induce CRT exposure pathways similar to anthracyclins.

All Na/K-ATPase inhibitors that were found amongst the 50 most efficient drugs of the screen were additionally tested for their capacity to expose CRT in WT cells assessed by antibody staining, a method distinct from the primary screening approach. As expected all the data from the primary screen could be validated with regard to Na/K-ATPase inhibitor induced CRT exposure (FIG. 28D). Most Na/K-ATPase inhibitors are intrinsically toxic due to their effect ion-homoeostasis, nevertheless CGs confer the ability to boost cardiac output by increasing cardiac contractility, mostly dependent on elevated intracellular calcium levels in cardiac myocytes. The CGs most widely used in clinics are digoxin and digitoxin, with the first being the most favoured. Focussing on these two inventors could show that both of them induce CRT exposure (FIG. 28F), HMGB1 release (FIG. 28G) and ATP release (FIG. 28H) in a dose dependent fashion but still within the therapeutic window for human application in the nanomolar range thereby validating the findings of the initial HTS approach.

Digoxin Induced Tumor Immunogenicity and Clinical Implication

For further validation anti tumor vaccination studies in immunocompetent mice were conducted. Prior to the in vivo experiments the cytotoxicity of CGs has been reevaluated as it is know that rodent cells are inherently insensitive for CGs (Perne et al., 2009). As expected CT26 an MCA cell were intrinsically insensitive to CGs treatment even at µM ranges compared to human cells as evidenced by Annexin/DAPI staining of mouse and human cells treated with different concentrations of CGs. Nevertheless when combined with the non immunogenic cell death inducer MitoC, which by its own is incapable of exposing CRT, both CGs tested caused exposure of CRT in cotreated cells (FIGS. 29A and 29B).

MCA cells cotreated with digoxin and MitoC inoculated into immunocompetent mice kept living cell of the same kind from forming a tumor as compared to MitoC alone that failed to confer any vaccinating effect (FIG. 29C). Due to its incapacity to induce cell death at the concentrations used digoxin treated cells used for the same studies led to tumor formation at the vaccination side and were therefore not further evaluated.

Retrospective clinical studies on breast cancer patients revealed an increased overall survival in patients that have received digoxin during chemotherapy. Subgroup analysis of this data showed that this effect completely disappears in anthracyclin based chemotherapy but is even more pronounce in non anthracyclin based treatments (FIG. 29D).

Conclusions

HTS designed for monitoring immunogenic signals induced by cytotoxic treatment enabled the screening of a huge number of drugs for their potential to cause or restore immunogenic cell death. Cardiac glycosides and in particular digoxin and digitoxin induced all features of immunogenic cell death. On the contrary MitoC fails to induce immunogenic tumor cell death that would allow the stimulation of an anticancer immune response and hence amplify its therapeutic efficacy. Thus, the combination of Digoxin with MitoC effectively induced immunogenic cell death, while each agent alone was inefficient. In addition clinical data underline the importance of this finding as CG cotreated patients depict an increased overall survival. Altogether, these results indicate again the contribution of ion fluxes especially $Ca^{2+}$ for the translocation of CRT to the cell surface.

Example 5

A Single-Nucleotide Polymorphism in Anyone of CCR1, EIF2AK2, DNAJC10 Genes Affects the Efficacy of Conventional Anti-Cancer Therapy in a Neoadjuvant Setting (Before Surgery) Breast Cancer Patients Inventors attempted to generate a molecular parameter signature of a pathological complete response (pCR) from two datasets of gene-expression arrays in neoadjuvant (before any surgery step) anthracycline treated-breast cancer patient cohorts (cohorts respectively herein identified HOUSTON FEC and IGGO FEC). One dataset of gene-expression arrays in neoadjuvant taxane treated-breast cancer patients was used as negative control (cohort IGGO TET). Inventors extracted a set of 43 genes from cohort HOUSTON FEC and 53 genes from cohort IGGO FEC/TET implicated in the "calreticulin" pathway from the global sets of genes identified previously in the description (using respectively 22 283 probes and 61 359 probes) to construct the molecular parameter signature.

Inventors performed a molecular classifier development analysis based on a supervised learning classification technique (Support Vector Machines—SVM) (FIG. 22). Leave-one-out cross-validation (LOOCV) was used to estimate the prediction accuracy of the rule determined on the training set (the previously mentioned 43 and 53 genes). One sample is left out, and the remaining samples are used to build the prediction rule, which is then used to classify the left-out sample. Then, they performed, in one hand, univariate analyses with contingency tables: the statistical significance of the discrimination between pCR and non-pCR patients was assessed by Fisher's exact test. In the other hand, multivariate methods, such as logistic regression and ROC analyses, were performed to validate the independency of the molecular parameter signature as compared to classical clinical factors [age at diagnosis, hormone receptors, tumor grade, tumor size (pT), node status (pN)] (FIG. 22).

To determine the optimal molecular classifier in each cohort, inventors classified the genes from the highest to the lowest significant based on a non parametric Mann-Whitney test between pCR and non-pCR groups, and they proceed to a systematic approach by testing the discrimination potential of decreasing sets of genes (from n=43/53 to 3) (FIG. 23). The best prediction rules were obtained with a molecular parameter signature based on 3 genes (HOUSTON FEC LOOCV, p=0.0005; IGGO FEC LOOCV, p=0.002; IGGO TET LOOCV, p=0.43) (FIG. 23). In multivariate analyses using logistic regression, the "Calreticulin" molecular classifiers based on the 3 most significant genes of each cohort were retained as the sole independent prognostic factors for pCR, except for the cohort IGGO TET (negative control) (FIG. 24A). ROC analyses revealed the ability of the 3 genes based—"Calreticulin" molecular classifiers to discriminate significantly pCR patients from non-pCR patients, except for the cohort IGGO TET where the predictive value of the model was based only on the pT factor (FIG. 24B). In order to identify the best molecular classifier in common between the two anthracycline treated cohorts, they compared the most discriminant genes between these two cohorts. The classifier was constructed with the 3 candidate genes located in the grey areas (FIG. 25). Univariate analyses based on non-pCR vs pCR contingency tables and multivariate analyses revealed that the common classifier based on the CCR1, EIF2AK2 and DNAJC10 gene expressions ("CALR pathway" signature) was able to predict accurately the response of a human subject having a tumor to anthracyclines (FIG. 26).

Inventors then attempted to optimize the molecular classifier by integrating host genetic parameters, such as single nucleotide polymorphisms, in the algorithm. Multivariate analyses in HOUSTON FEC cohort revealed that the association of a MTHFR SNP (rs1801133) with the "CALR pathway" signature improved the prediction accuracy of the molecular classifier (FIG. 27). This MTHFR SNP was the most discriminant SNP between pCR and non pCR groups among a set of 384 selected SNPs located in immune candidate genes (Table 1). The interpretation of results revealed in particular that patients carrying the mutated allele of MTHFR SNP (rs1801133) associated with an over-expression of CCR1 and EIF2AK2 genes, and an under-expression of DNAJC10 gene, have higher chance to respond to anthracyclines than patients carrying the wild-type allele of MTHFR SNP associated with an under-expression of CCR1 and EIF2AK2 genes, and an over-expression of DNAJC10. These results demonstrate that tumour parameters, such as gene expression signatures, and host (the subject having a tumor) genetic parameters, such as SNPs, constitutes a powerful combination usable to predict or assess the response of a subject to a treatment of cancer, in particular to anthracyclines.

Material and Methods:

Cohort F. André (IGR/Houston) (described in Lancet Oncol. Submitted).

Patients for gene expression analysis and metagene predictor validation have been selected from a database of 591 patients who received preoperative anthracyclines-based, taxanes-free chemotherapy at the Institut Gustave Roussy between 1987 and 2003. Inclusion criteria consisted of (1)

pathologic complete response (pCR) defined as the absence of any invasive cancer or isolated tumor cells in the breast after completion of chemotherapy and (2) availability of frozen, pre-treatment samples in the institutional tumor bank for molecular analysis. Twenty six cases were identified and 26 additional cases were selected as controls. The controls included tumors that were resistant to chemotherapy defined as less than 75% clinical response and residual invasive disease (RD) present at the time of pathologic exam after chemotherapy, and were matched for Endoplasmic Reticulum (ER)-expression. A further double-checking of clinical characteristics revealed that one patient with pCR actually received 2 cycles of docetaxel in addition to 4 courses of FEC (anthracyclines). This patient was retained in the analysis. The study was approved by the local IRB; all patients signed informed consent for tumor banking and future molecular analysis of their tissues.

Cohort R. Iggo/H. Bonnefoi (Bonnefoi et al, 2007) EORTC

Breast cancer patients treated in neoadjuvant (before any surgical step) FEC versus TET (anthracyclines versus taxanes) Data basis on tumor profiling (microarrays) described in Lancet Oncol 2007 and available online The microarray analyses, such as SVMs (Brown et al., 2000) and non parametric Mann-Whitney test, were performed with the MEV software version 4.5 (Saeed et al., 2006; Saeed et al., 2003). For multivariate logistic regression and ROC (Receiver operating characteristic) analyses, the SPSS 18.0 software was used. The Fisher's exact test was performed with the StatEL software (ad Science, France).

In clinical databases, when a category of an ordinal variable had too few observations in databases, these observations were pooled with a consecutive category (tumor size T1 and T2, node status N1 and N2 and grade 1 and 2). Missing values for grade, pN and SNPs were assigned to a separate category to avoid a decrease in the sample size in the logistic regression analysis.

Example 6

A Single-Nucleotide Polymorphism in Anyone of NLRP4, DDX58, CX3CR1, FAT2, MTHFR Genes Affects the Efficacy of Conventional Anti-Cancer Therapy in a Neoadjuvant Setting (Before Surgery) Breast Cancer Patients The inventors observed that the single-nucleotide polymorphism (SNP) A/T Gln925Leu (Q925L-rs302453-SEQ ID NO:60) in NLRP4 gene (NCBI Gene Reference: NM_134444.4)) affects the efficacy of conventional anti-cancer therapy in terms of pathological complete response (pCR) and metastasis free survival in a neoadjuvant setting in breast cancer patients (n=443 and n=441, respectively). Indeed, a meta-analysis combining the results of three studies revealed that the proportion of pathological complete responses was higher in NLRP4-rs302453 mutated group than in wild-type group of patients treated with anthracyclines (20.9% in patients carrying the NLRP4 Gln925Leu mutated allele versus 14.1% in patient with the normal allele; p=0.04 by Chi2 analysis) (FIG. 30A). This association was confirmed by multivariate analyses using logistic regression by taking into account the effects of classical clinical factors. The NLRP4-rs302453 factor appeared independently associated to pathological complete responses (adjusted P-value=0.006, OR=2.14, 95% CI [1.23-3.70]) (FIG. 30B). The meta-analysis combining the results of three survival studies based on univariate and multivariate approaches revealed that the NLRP4-rs302453 was associated with a lower frequency of metastasis in patients carrying the NLRP4 Gln925Leu mutated allele than in patient carrying the normal allele (Log Rank p=0.09, FIG. 31A; Cox model adjusted P-value=0.05, OR=0.69, 95% CI [0.48-1.01], FIG. 31B).

In other words, the NLRP4 Gln925Leu mutated allele (rs302453) decreases the probability of metastatic relapse in patients treated with anthracyclines.

Inventors also found that SNPs residing in DDX58/RIG-1 (cytosolic sensor for viral nucleic acids) (A/T-Asp508Glu, D580E-rs17217280-NCBI Gene Reference: NM_014314.3-SEQ ID NO: 17), CX3CR1 (A/G-Thr280Met, T280M-rs3732378-NCBI Gene Reference: NM_001171171.1-SEQ ID NO: 39), genes impact on the prediction in a multivariate Cox model (integrating proliferation index, HER2/HR status) (FIG. 32). Therefore, inventors propose to validate such predictors integrating factors of the host-tumor immune equilibrium (the CRT map pathway and the immune receptors) aimed at predicting therapeutic responses to anthracycline/taxane-based therapies in BC using simple nucleic acid probes on home made chip arrays that we should set up for routine use starting from a tumor biopsy at diagnosis (algorithm presented in FIG. 27).

The high performance signature found in the neoadjuvant paired cohort (FIG. 33 A) was cross-validated in a second independent neoadjuvant BC cohort (REMAGUS II) containing >260 patients. The FIG. 33 B shows the performance (accuracy and AUC) of signatures of varying length (number of SNPs) trained on the first paired cohort (called "Houston") and tested on REMAGUS II. We observe that the optimal size of the signature is around 5 (instead of 2 for cross-validation estimation (FIG. 33 A)), suggesting that a larger signature may bring additional information. The performance is better for HER2 neg HR+ samples than HER2+ (FIG. 33 B and FIG. 33 C).

These data indicate the power of at least 2 associated SNPs those encoding MTHFR(C/T-Ala222Val, A222V-rs1801133-NCBI Gene Reference: NM_005957.4-SEQ ID NO:194) and FAT2 (C/T-Arg574Cys, R574C-rs1432862-SEQ ID NO:162; or T/C-Leu3514Ser, L3514S-rs2053028-SEQ ID NO:216; or G/A-Met3631Ile, M3631I-rs6650971-SEQ ID NO: 403-NCBI Gene Reference: NM_001447.2), listed in Table 6 and the classical clinical factors to design an accurate model predictive of response to neoadjuvant, anthracycline-based therapy. The mutation of MTHFR and FAT2 brings a selective advantage to respond to therapy.

In addition, we corroborated the predictive value of DDX58 and FAT2 in a third independent cohort of neoadjuvant breast cancer (BC) as predictive factors of disease free survival (FIG. 33 D).

TABLE 4

(RCH signature)

|  | Weigth |
|---|---|
| (Intercept) | −136.84 |
| GREE | 57.35 |
| RH | −16.87 |
| HER2 | −38.35 |
| rs1801133 | 59.68 |
| rs1432862 | −37.37 |

Two highly significant SNPs in neoadjuvant (MTHFR: rs1801133 and FAT2: rs1432862) in a multivariate Cox model (integrating proliferation index and HR status).

Material and Methods
Clinical Study Design

The inventors retrospectively constructed patient database using data obtained from Institut Gustave Roussy, Villejuif and Centre George François Leclerc, Dijon (France). All patients provided written informed consent for enrollment in the study. Eligible patients had histologically confirmed sporadic breast cancer. All patients received an anthracycline-based chemotherapy before surgery (FEC+taxanes 6 cycles in neoadjuvant setting, HER2+ patients have been excluded). This study was based on the REMAGUS cohort (n=202—patients not treated with Herceptin), the Dijon cohort (n=251) and the Houston case-control cohort (n=58) matched for age, tumor grade and hormone receptors. The primary endpoints of the studies were the pathogical complete response and the metastatic relapse. After generation of the patient database and collection of genomic DNA samples, genotyping and statistical analyses were performed in a blinded fashion. A total of 443 patients fulfilled the inclusion criteria. Chi square test was used to compare the distribution of clinical characteristics across the two genotype groups. All analyses were carried out using SPSS software, version 16 (IBM SPSS Statistics, France).

Genotyping

DNA was isolated from frozen blood leukocytes from subjects. The TAQMAN Genotyping assay ID: C_11170747_20 was used to genotype the NLRP4 (rs302453). The TAQMAN Genotyping assay ID: C_25963266_10 was used to genotype the DDX58 (rs17217280). The TAQMAN Genotyping assay ID: C_5687_1 was used to genotype the CX3CR1 (rs3732378). The TAQMAN Genotyping assay ID: C_1202883_20 was used to genotype the MTHFR (rs1801133) The TAQMAN Genotyping assay ID: C_11159313_1 was used to genotype the FAT2 (rs2053028). The TAQMAN Genotyping assay ID: C_25639416_10 was used to genotype the FAT2 (rs6650971). The TAQMAN Genotyping assay ID: C_8949947_20 was used to genotype the FAT2 (rs1432862) Briefly, 10 ng of genomic DNA was mixed with 5 μL of 2× TaqMan Genotyping Master Mix (Applied Biosystems) and 0.25 μL of 40× genotyping assay in a final volume of 10 μL. Temperature cycling and real time fluorescence measurement were done using an StepOnePlus System (Applied Biosystems). The genotypes were assigned to each subject, by comparing the signals from the two fluorescent probes, FAM and VIC, and calculating the −log(FAM/VIC) ratio for each data point with the StepOne software v2.0 (Applied Biosystems).

Cohort REMAGUS:

Breast cancer patients (n=202) treated in neoadjuvant (before any surgical step).

Cohort Dascier:

Paired study of 35 responders and 35 non responders, the pairing being made on all clinical prognostic factors for Breast Cancer (BC).

Example 7

Tumor Cells Undergoing Immunogenic Cell Death after Chemotherapy are Characterized by a Viral Gene Signature-Like First Evidences Gene microarray analyses have been performed on Tumor cells harvested from mice which have been treated by either PBS or Doxorubicin, 2 days before. About 30 gene expressions have been identified to increase up to 4 fold change upon doxorubicin treatment (Table 3). All these genes are involved in viral recognition and/or Interferon pathway and/or immune functions.

TABLE 3

Candidate genes list identified by Microarray analysis.

| Official symbol | Day 2 Fold change | Official name | Common name | Gene ID (Human) | Gene ID (Mice) |
| --- | --- | --- | --- | --- | --- |
| Rsad2 | 4.07 | radical S-adenosyl methionine domain containing 2 | Viperin | 91543 | 58185 |
| Cxcl10 | 3.27 | | | 3627 | 15945 |
| Ccl4 | 3.15 | | | 6351 | 20303 |
| Irf7 | 3.03 | interferon regulatory factor 7 | | 3665 | 54123 |
| Il15 | 2.98 | | | 3600 | 16168 |
| Ifit2 | 2.89 | interferon-induced protein with tetratricopeptide repeats 2 | IFIT-2, GARG-39, IFI-54K | 3433 | 15958 |
| Dhx58 | 2.87 | RNA helicase LGP2, probable ATP-dependent RNA helicase DHX58, RIG-I-like receptor | LGP2 | 79132 SEQ ID NO: 528 | 80861 SEQ ID NO: 529 |
| Ifi205 | 2.61 | interferon-inducible protein p205-A | p205 | | 226695 |
| Trim30 | 2.54 | tripartite motif-containing protein 30 | Trim30A | | 20128 |
| Cd274 | 2.31 | | PD-L1 | | |
| Cd69 | 1.96 | | CD69 | | |
| Ly6c1 | 1.94 | | Ly6C | | |
| Cxcl1 | 1.93 | | Cxcl1 | 2919 | 14825 |
| Ifnb1 | 1.87 | | Ifnb1 | 3456 | 15977 |
| Ccl7 | 1.81 | | Ccl7 | 6354 | 20306 |
| Ccl2 | 1.66 | | Ccl2 | 158105 | 20296 |
| Ccl3 | 1.27 | | Ccl3 | 6348 | 20302 |
| Tnfrsf9 | 1.42 | | 4-1BB | | |
| Irf3 | 1.05 | | Irf3 | 3661 | 54131 |
| Oasl1 | 3.21 | | | | 231655 |
| Oas2 | 3.08 | | | 4939 | 246728 |
| Mx2 | 2.53 | | | 4600 | 17858 |
| Mx1 | 1.68 | | | 4599 | 17857 |
| stat4 | 1.04 | | | | |
| Mavs | ND | mitochondrial antiviral signaling protein | MAVS, IPS-1, CARDIFF | 57506 | 228607 |

TABLE 3-continued

Candidate genes list identified by Microarray analysis.

| Official symbol | Day 2 Fold change | Official name | Common name | Gene ID (Human) | Gene ID (Mice) |
|---|---|---|---|---|---|
| Irf1 | ND | | | 3659 | 16362 |
| Stat3 | ND | | | | |
| Ccl5 | ND | | | 6352 | 20304 |
| Cxcl9 | ND | | | 4283 | 17329 |
| Ly6g | ND | | | | |
| Cxcl2 | ND | | | 2920 | 20310 |
| Tnf | ND | | | 7124 | 21926 |
| Il12 | ND | | | 3592 | 16159 |
| Ppia | | | | 5478 | 268373 |
| Cdl1c | ND | | | | |
| Cdl1b | ND | | | | |

Then inventors confirm by Real Time PCR the data provided by micro-array analysis.

Results

We confirmed by RT-PCR that genes involved in viral recognition and in anti-viral immune responses are specifically up-regulated 2 days after doxorubicin treatment (FIG. 35).

We confirmed that these genes are up-regulated day 2 after chemotherapy: Rsad2, Dhx58, Ifi205, Trim30, Mx1, Oas2, Mx2, Ifit2, Il15, Irf7, Ifnb1, Cxcl1, Cxcl10, Ccl2, Ccl3, Ccl4, Ccl7 and Il12a while Mavs, Irf3, Irf1 and Tnf were unchanged.

These genes are expressed majorly in CD45+ fraction: Rsad2, Ifi205, Mx1, Ifnb1, Ifit2, Il15, Irf7, Ccl4, Ccl7, Ccl3, Tnf, Il12a.

Both CD45+ and CD45− fractions contribute to Irf1, Irf3, Ccl2, Cxcl1, Cxcl10, Dhx58, Mavs expression.

Conclusion

Doxorubicin-induced Immunogenic Cell Death is characterized by a viral gene signature-like triggering. These genes probably highlight the crucial pathway that allows a reactivation and/or de novo generation of a potent anti-tumor immune response which is indispensable for therapeutic success. Thus, this viral gene signature like appears as a potent predictor for immunogenic tumor cell death and probably for the response to chemotherapy and therapeutic success.

Material and Method

Experimental Setting: (FIG. 34)

Tumor Cells, Chemotherapy Treatment.

0.8 Million of MCA 205 has been subcutaneously implanted to C57Bl6 mice. When tumors reached 36 to 42 mm$^2$ (about 7 days later), mice have been intratumorally treated by either PBS or Doxorubicin (Doxo) (2 mM, 50n1). (4 groups: PBS or Doxo Treated, Day 2 or Day 8 post treatment, 6 mice/group).

RNA Extraction, Reverse Transcription into cDNA and Quantitative RT-PCR Analysis of Gene Expression.

Tumor samples were freshly collected, briefly washed in RPMI1640 media (GIBCO). Tissue samples were cut to a maximum thickness in any one dimension of 0.5 cm, placed in 5 volumes of RNAlater® (SIGMA ALDRICH). Samples can be stored at room temperature if processed for RNA extraction on the same day or stored at 4° C. for less than 1 month. RNA extraction from each tumor (up to 30 mg/sample) was performed using RNeasy Mini Kit (QIAGEN) following the instructions.

RNA concentration and purity was tested by NanoDrop Spectrophotometers (Thermo Scientific). Reverse transcription: mRNA (containing 2.5-5 µg RNA in 30 ul RNase and DNase free water) was incubated at 65° C. 10 min, then placed on ice for 2 min.

Add 20 µl of Master mix (dN6 (3 ng/µl), dNTP (1 mM), Buffer (1×), RNAsin (40 U) Superscript® III RT (200 U)) into the processed mRNA sample. Mix was incubated at 50° C. for 1 h and then inactivated at 75° C. for 15 min.

qRT-PCR.

cDNA of each sample was diluted at 1:3 with DNase free water. For each sample, 4 µl of primer and probe TAQMAN (2×), 10 µL1 of assay mix (20×), 5 µl diluted cDNA were added. qRT-PCR was performed (45 cycles with standard PCR program using StepOnePlus™ system (Applied Biosystems). PPIA was used as endogenous control gene to normalize gene expression for data analysis.

Example 8

Anti-Calreticulin Antibody Response is a Predictive and Prognostic Factor for the Clinical Response to Anthracyclines and Metastasis-Free Survival in Breast Cancer Patients Material and Methods IgA and IgG anti-calreticulin antibody levels before and after chemotherapy by anthracyclines were analyzed in 107 sera from a cohort of neo-adjuvant breast cancer patients. Each value represents the arithmetical average of 4 different assays. Two different dilutions of sera were used: 1/20 and 1/100 in case of IgA antibodies and 1/100 and 1/500 in case of IgG anti-calreticulin antibodies. Each serum sample and standard serum were analysed in triplicate. The highest optical density (OD) of negative controls was subtracted from the mean of OD measured.

The mixture of the sera of patients (suffering from active celiac disease, refractory celiac sprue, autoimmune hepatitis type I, primary hepatocellular carcinoma, pancreatic adenocarcinoma and gall-bladder adenocarcinoma) with various seropositivity for anti-calreticulin antibodies was used as a standard. There were differences among antigenic epitopes of CRT recognized by IgA and IgG antibodies (previously tested by Pepscan) in these serum samples.

Determination of serum levels of antibodies against calreticulin: An enzyme-linked immunosorbent assay (ELISA) for testing the serum levels of IgA and IgG anti-calreticulin antibodies was performed as described in previous studies [Sanchez et al., 2008, 2003]. Briefly, human recombinant calreticulin used in a final concentration of 5 mg/ml of phosphate-buffered saline (PBS) was coated on 96-well polystyrene plates (Gama, Czech Republic) overnight at 4° C. Blocking buffer [1% bovine serum albumin (BSA) in PBS; Sigma, Germany] was used as a negative control. Each serum sample and standard serum were diluted in blocking buffer.

Serum levels of anti-calreticulin antibodies were expressed as arbitrary units (AU), the optical density of an internal standard serum being used as reference (i.e. taken as 100%). The cut-off value for anti-calreticulin antibodies was calculated as the mean value plus two standard deviations from the data pool of the 75 control sera samples. Cut-off values—calculated as the mean value plus two standard deviations from the data pool of the 75 control sera samples—are 60 AU for IgA anti-CRT antibodies and 90 AU for IgG anti-calreticulin antibodies. Values exceeding the cut-off were considered as positive. The non parametric Mann-Whitney U test was used for statistical analysis.

Results

The levels of anti-calreticulin antibodies in breast cancer cohort reach 47.7±23.8 (mean±standard deviation) for IgA and 83.8±40 AU for IgG isotype. The levels of anti-calreticulin antibodies in healthy volunteers group was 32.4±13.8 for IgA and 52.9±18.7 AU for IgG isotope ($p<0.001$) (FIG. 36).

The fractions of your sera for anti-calreticulin antibodies are: 27/107 vs 4/75 for IgA and 37/107 vs 7/75 for IgG antibodies in Breast Cancer patient vs Healthy volunteers, respectively (FIG. 37).

For 9 patients, inventors were able to study samples at diagnosis and after chemotherapy. Despite the few number of patients, it appears that a negative serology at the diagnosis and a sero-conversion during the treatment course are associated to a good prognosis.

For example the patient 6, who responded to the treatment and didn't relapse was seronegative at the diagnosis and then develop a humoral response against Calreticulin (FIG. 38, left panel). Conversely, the patient 4 who didn't respond to the treatment and relapsed was sero-negative at the diagnosis and failed to acquire anti-Calreticulin antibody under chemotherapy. (FIG. 38, right panel).

Conclusion

The level of 1 g anti-Calreticulin at diagnosis and the dynamic acquisition of such antibody during the treatment course are directly correlated to the response to anthracycline chemotherapy and metastasis free survival in Breast Cancer patients.

Example 9

Autophagy is Required for the Immunogenicity of Cell Death and is Triggered by Anthracyclines and Oxaliplatine The outcome of chemotherapy can be influenced by the host immune system at multiple levels. Inventors working hypothesis that chemotherapy can kill cancer cells in a way that they elicit an immune response is herein examined. They have accumulated data indicating that the history of pre mortem stress—including endoplasmic reticulum (ER) stress and autophagy—determines whether cell death is perceived by the immune system as immunogenic, causing the engulfment, processing and presentation of tumour antigens by antigen-presenting cells, followed by a cellular anticancer immune response that increases the efficacy of anticancer chemotherapies (Casares et al. JEM 2005, Obeid et al., Nat Med 2006, Apetoh et al. Nat Med 2007, Ghiringhelli et al. Nat. Med. 2009, Zitvogel et al. Nat Rev Immunol 2008). Inventors found that ER stress can culminate in the translocation of an ER protein, calreticulin, to the cell surface where it serves as an engulfment signal for dendritic cells (DC).

Surrogate markers of an ongoing ER stress response can be studied in immunohistochemistry (1HC) using specific antibodies recognizing phosphorylated eif2alpha, calreticulin, ERp57, HMGB1 on initial breast cancer core biopsies (paraffin embedded tissues or frozen specimen). Typical stainings for phosphorylated eif2alpha and HMGB1 are showing in FIG. 39 A. The staining of CRT is cytosolic, quoted positive or negative (intensity of staining is not important for the scoring), more than half of BC being negative at diagnosis. The staining of ERp57 is positive when ERp57 is at the plasma membrane (since most BC are positive, only ⅛ BC present with a relocation of cytosolic ERp57 to plasma membrane). The staining of HMGB1 should be inverted, meaning that the nuclei should become negative while the cytosol should become highly positive including those where there is a perinuclear reenforcement of the staining. Phosphorylated eif2a is a cytosolic staining which should be quite homogeneous and intense to be quoted positive (about ⅔ of specimen). Each IHC criteria counting for 1, the maximum score of a given tumor specimen is 4 while the minimal score is 0. In responders (patients whose tumor exhibits a pathological complete response post chemotherapy), ⅔ of tumors at diagnosis presented with a score>2 while in non responders, ⅓ of tumors at diagnosis presented with a score>2 (FIG. 39 B). Moreover, inventors unpublished data indicate that pre mortem autophagy is required for dying cells to release ATP, which acts on purinergic receptors to stimulate DC for optimal tumour antigen presentation. Thus, pre-apoptotic ER stress and autophagy determine the emission of immunogenic signals—CRT exposure and ATP secretion—as tumour cells die.

As a result, inventors herein identify the anticancer cytotoxic agents which are particularly efficient in inducing ER stress and autophagy, and demonstrate (i) that a mechanistic and perhaps hierarchical relationship between ER stress and autophagy exists, (ii) that cytotoxic agents inducing ER stress plus autophagy always induce immunogenic cell death in vivo, and (iii) that compensatory therapies can be developed to overcome defects in immunogenic cell death at the level of ER stress or autophagy.

Inventors also describe the analysis of clinical samples from patients with neoadjuvant treated breast cancers or adjuvant colorectal carcinoma (CRC), and determine the impact of ER stress and autophagy on chemotherapeutic responses or prognosis thereby validating their working hypothesis that ER stress and autophagy play a decisive role in eliciting anticancer immune responses and in improving the efficacy of antineoplastic therapies.

As mentioned above, CRT exposure and ATP release constitute obligatory immunogenic signals. Without CRT exposure or without ATP release, tumour cell death is detected as non-immunogenic. This means that chemotherapeutic agents that fail to induce CRT exposure or ATP release cannot induce immunogenic cell death. Moreover, tumour cells that have lost their capacity to expose CRT on the surface or to secrete ATP from tumours become refractory to therapy with normally immunogenic cell death inducers such as anthracyclines (Kepp, Cancer Met Rev, 2011, Martins I, Oncogene 2010, Martins I, Ann NY Acad Med 2010). Inventors report that CRT exposure critically relies on an ER stress response that is usually triggered by immunogenic cell death inducers such as anthracyclines. Accordingly, they found that the stable knockdown of PERK, a kinase involved in the ER stress response, abolished CRT exposure and the immunogenicity of anthracycline-induced cell death. In an attempt to restore this defect, they screened the IBBC library of bioactive compounds to identify agents that can restore CRT exposure. Inventors found that thapsigargin (example 3), an inhibitor of the SERCA pump and a prototypic ER stress inducer, was the sole agent (out of 450 compounds) to induce CRT exposure in the presence of cisplatin but not in the absence of cisplatin. Indeed, thapsigargin and another ER stressor, tunicamycin, could induce immunogenic cell death when combined with cisplatin, underscoring the importance of ER stress for the induction of immunogenic cell death (Martins I et al, Oncogene 2010).

Inventors unpublished data also indicate that macroautophagy ("autophagy") is surprisingly required for ATP release. Intracellular ATP can be quantified with quinacrine, which accumulates in ATP-rich intracellular structures and then emits a green fluorescence, even after aldehyde fixation of the cells. This signal can be detected by fluorescence microscopy or flow cytometry. Only those chemotherapeutic agents that cause pre-lethal autophagy can induce ATP release, and autophagy-deficient tumour cells fail to release ATP after blockade of the autophagic pathway by knockdown of essential autophagy (Atg 5, 6, 7, 12) genes (FIG. 40). Inventors can visualize autophagy in chemotherapy treated mouse tumors in vivo using LC3-GFP engineered CT26 or MCA205 where microtubule-associated protein 1 light chain 3 alpha (LC3) can be observed in frozen tissues in immunofluorescence (FIG. 41). Autophagy may be assessed using the following parameters: a mixture Ab targeting LC3 and gate 16/GABARAP members.

Importantly, such autophagy-deficient tumour cells fail to immunize against live tumour cells when they are treated with anthracylines in vitro and injected subcutaneously into immunocompetent mice, in conditions in which normal (autophagy-competent) dying tumour cells are immunogenic (FIG. 42). This defect in immunogenicity can be restored by elevating the extracellular ATP concentration, namely by co-injection of the ecto-ATPase (apyrase) inhibitor ARL67156 (FIG. 43).

Moreover, autophagy-deficient tumours which have been established for 8 days (implanted in mice eight days before injection of chemotherapy) fail to respond to anthracycline-based chemotherapy in vivo, and this defect is again overcome by intratumoural injections of ARL67156 (FIG. 44). These data underscore the importance of ER stress and autophagy for rendering cell death immunogenic and hence for enhancing anticancer immune responses in vivo. A preliminary screen on 2000 anticancer agents indicates that only a minority can induce both autophagy and ER stress, suggesting that only a few are endowed with the capacity to induce immunogenic cell death.

Material and Methods

FIG. 38. The Core Machinery of Autophagy is Indispensable for ATP Release During Exposure with Immunogenic Chemotherapies.

FIG. 38 upper panel. Mouse embryonic fibroblasts (MEF) genetically modified by small interfering RNA blocking the expression of ATG5 have been exposed ex vivo for 48 hours with increasing dosing of oxaliplatin (OX) or mitoxanthrone (an anthracycline, MX). The percentages of Quinacrine negative cells, assessed by immunofluorescence (GFP emission) represent the proportions of cells that have lost intracellular ATP. The positive control for autophagy induction is starvation.

FIG. 38 lower panel. Mouse colon cancer CT26 have been knock down for the expression of several family members of the core machinery of autophagy (by means of small interfering RNA, two different specific siRNA for ATG5, 6 or 7 and control siRNA (siSC)) and then subjected to ex vivo exposure with mitoxanthrone (MX) or control saline (CT). ATP release is indirectly measured by the percentages of cancer cells that have lost quinacrine expression.

FIG. 39. Induction of Autophagy In Vivo Following Chemotherapy of Established Tumors.

After 8 days of tumor implantation (CT26 mouse colon cancer genetically modified to overexpress LC3-GFP in BALB/c immunocompetent mice), oxaliplatin or mitoxanthrone was inoculated systemically (i.v.). Tumors were withdrawn at 48 hours post-therapy and immunofluorescence stainings were performed on frozen sections of tumor tissues to visualize nuclei (in Hoechst blue), and autophagosomes in green (LC3-GFP). Redistribution of LC3-GFP in autophagosomes can be visualized post-therapy with both cytotoxic agents (mitoxanthrone MTX and oxaliplatin) as shown in representative micrograph pictures (upper panels). The lower panel is a graph summarizing enumeration of autophagosomes positive cells in 10 independent sections per tumor and animal (each dot represents one tumor). Statistical analyses were performed with Anova test (Fisher's exact method) with significant results at $p<0.05$.

FIG. 40. Prophylactic Immunization with Dying Tumor Cells is Impaired when Dying Cells are Autophagy-Deficient.

One million CT26 knock down with small interfering RNA specific for ATG5 or ATG7 or controls WT were treated with the anthracyclin mitoxanthrone (MTX) at 8 days post-implantation in one flank of a naïve animal (BALB/C mouse). The lower graphs indicate that the growth of ATG5 and ATG7 deficient tumors are not controlled by MTX therapy in contrast to CT26 WT which significantly respond to anthracyclines. However, the upper graphs show that when apyrase inhibitors (AI) are co-administered locally in tumor beds along with chemotherapy (i.v. inoculated), tumors start to regress with the cytotoxic agent. Monitoring of tumor growth was recorded with a caliper (product of perpendicular diameters) and is depicted for 5 mice/group. Statistical analyses were performed with Anova test (Fisher's exact method) with significant results at $p<0.05$.

FIG. 41. Compensatory Therapy for Autophagy Deficient Cells: Apyrase Inhibitors Restore the Immunogenicity of Autophagy-Deficient Dying Tumor Cells.

Idem as in FIG. 40 but the dying cells (siCO or siATG7) were admixed (or not) with apyrase inhibitors (AI) (apyrases are enzymes hydrolyzing ATP in the extracellular milieu) and/or suramine (SUR) or oxidized ATP (OXY), both inhibitors of purinergic receptors at the conventional dosing (previously reported). The % of tumor free animals are shown in the graph and the number of animals per group is indicated (n=20). Statistical analyses were performed with Anova test (Fisher's exact method) with significant results at $p<0.05$.

FIG. 42. Autophagy-Deficient Tumors Failed to Properly Respond to Chemotherapy Unless Apyrase Inhibitors are Coadministered Along with Chemotherapy.

One million CT26 knock down with small interfering RNA specific for ATG5 or ATG7 or controls WT were treated with the anthracyclin mitoxanthrone (MTX) at 8 days post-implantation in one flank of a naïve animal (BALB/C mouse). The lower graphs indicate that the growth of ATG5 and ATG7 deficient tumors are not controlled by MTX therapy in contrast to CT26 WT which significantly respond to anthracyclines. However, the upper graphs show that when apyrase inhibitors (AI) are co-administered locally in tumor beds along with chemotherapy (i.v. inoculated), tumors start to regress with the cytotoxic agent. Monitoring of tumor growth was recorded with a caliper (product of perpendicular diameters) and is depicted for 5 mice/group. Statistical analyses were performed with Anova test (Fisher's exact method) with significant results at $p<0.05$.

Example 10

Compensatory Therapy Using TLR4 and 4-1BB Agonists

Material and Method
TLR4Agonist:

MCA205 or EL4 tumor cell lines were subcutaneously implanted to C57Bl6 mice. Seven days later, MCA 205 or EL4 tumor bearing mice were treated by either PBS or chemotherapy (Doxorubicin intra tumoral (i.t.) or Oxaliplatin intra peritoneal (i.p.) respectively). At day 3 and 5 post chemotherapy, some mice were treated i.t with 2 µg of Dendrophilin, a TLR4 agonist.

4-1BB Agonist:

MCA205 or EL4 tumor cell lines were subcutaneously implanted to C57Bl6 mice. Seven days later, MCA 205 or EL4 tumor bearing mice were treated by with either PBS or chemotherapy (Doxorubicin i.t. or Oxaliplatin i.p respectively).

At day 3, 6 and 9 post chemotherapy, some mice were treated i.p. with 100 µg of 4-1BB agonist.

Results

PBS treated mice cannot control the tumor growth whereas chemotherapy-treated mice are able to do so. Dendrophilin combined with Chemotherapy increases the control of the tumor growth, meaning that TLR4 agonists potentiate the immunogenicity of anthracyclines and oxaliplatin in 2 tumor models (FIG. 45)

PBS treated mice cannot control the tumor growth whereas chemotherapy-treated mice are able to do so. 4-1BB agonist combined with Chemotherapy increases the control of the tumor growth, meaning that 4-1BB agonists potentiate the immunogenicity of anthracyclines and oxaliplatin in 2 tumor models (FIG. 46).

REFERENCES

Apetoh, L., F. Ghiringhelli, A. Tesniere, M. Obeid, C. Ortiz, A. Criollo, G. Mignot, M. C. Maiuri, E. Ullrich, P. Saulnier, H. Yang, S. Amigorena, B. Ryffel, F. J. Barrat, P. Saftig, F. Levi, R. Lidereau, C. Nogues, J. P. Mira, A. Chompret, V. Joulin, F. Clavel-Chapelon, J. Bourhis, F. Andre, S. Delaloge, T. Tursz, G. Kroemer, and L. Zitvogel. 2007. Toll-like receptor 4-dependent contribution of the immune system to anticancer chemotherapy and radiotherapy. Nat Med 13:1050-1059.

Boucontet, L., N. Sepulveda, J. Carneiro, and P. Pereira. 2005. Mechanisms controlling termination of V-J recombination at the TCRgamma locus: implications for allelic and isotypic exclusion of TCRgamma chains. J Immunol 174:3912-3919.

Casares, N., M. O. Pequignot, A. Tesniere, F. Ghiringhelli, S. Roux, N. Chaput, E. Schmitt, A. Hamai, S. Hervas-Stubbs, M. Obeid, F. Coutant, D. Metivier, E. Pichard, P. Aucouturier, G. Pierron, C. Garrido, L. Zitvogel, and G. Kroemer. 2005. Caspase-dependent immunogenicity of doxorubicin-induced tumor cell death. J Exp Med 202:1691-1701.

Dechanet, J., P. Merville, A. Lim, C. Retiere, V. Pitard, X. Lafarge, S. Michelson, C. Meric, M. M. Hallet, P. Kourilsky, L. Potaux, M. Bonneville, and J. F. Moreau. 1999. Implication of gammadelta T cells in the human immune response to cytomegalovirus. J Clin Invest 103:1437-1449.

Do, J. S., P. J. Fink, L L1, R. Spolski, J. Robinson, W. J. Leonard, J. J. Letterio, and B. Min. Cutting Edge: Spontaneous Development of IL-17-Producing {gamma} {delta} T Cells in the Thymus Occurs via a TGF-{beta}1-Dependent Mechanism. J Immunol Doisne, J. M., C. Becourt, L. Amniai, N. Duarte, J. B. Le Luduec, G. Eberl, and K. Benlagha. 2009. Skin and peripheral lymph node invariant NKT cells are mainly retinoic acid receptor-related orphan receptor (gamma)t+ and respond preferentially under inflammatory conditions. J Immunol 183:2142-2149.

Ghiringhelli, F., L. Apetoh, A. Tesniere, L. Aymeric, Y. Ma, C. Ortiz, K. Vermaelen, T. Panaretakis, G. Mignot, E. Ullrich, J. L. Perfettini, F. Schlemmer, E. Tasdemir, M. Uhl, P. Genin, A. Civas, B. Ryffel, J. Kanellopoulos, J. Tschopp, F. Andre, R. Lidereau, N. M. McLaughlin, N. M. Haynes, M. J. Smyth, G. Kroemer, and L. Zitvogel. 2009. Activation of the NLRP3 inflammasome in dendritic cells induces IL-1beta-dependent adaptive immunity against tumors. Nat Med 15:1170-1178.

Godfrey, D. I., D. G. Pellicci, O. Patel, L. Kjer-Nielsen, J. McCluskey, and J. Rossjohn. 2009. Antigen recognition by CD1d-restricted NKT T cell receptors. Semin Immunol Hamada, S., M. Umemura, T. Shiono, K. Tanaka, A. Yahagi, M. D. Begum, K. Oshiro, Y. Okamoto, H. Watanabe, K. Kawakami, C. Roark, W. K. Born, R. O'Brien, K. Ikuta, H. Ishikawa, S, Nakae, Y. Iwakura, T. Ohta, and G. Matsuzaki. 2008. IL-17A produced by gammadelta T cells plays a critical role in innate immunity against listeria monocytogenes infection in the liver. J Immunol 181:3456-3463.

Hinrichs, C. S., A. Kaiser, C. M. Paulos, L. Cassard, L. Sanchez-Perez, B. Heemskerk, C. Wrzesinski, Z. A. Borman, P. Muranski, and N. P. Restifo. 2009. Type 17 CD8+ T cells display enhanced antitumor immunity. Blood 114: 596-599.

Ivanov, I I, B. S. McKenzie, L. Zhou, C. E. Tadokoro, A. Lepelley, J. J. Lafaille, D. J. Cua, and D. R. Littman. 2006. The orphan nuclear receptor RORgammat directs the differentiation program of proinflammatory IL-17+ T helper cells. Cell 126:1121-1133.

Jensen, K. D., X. Su, S. Shin, L. L1, S. Youssef, S. Yamasaki, L. Steinman, T. Saito, R. M. Locksley, M. M. Davis, N. Baumgarth, and Y. H. Chien. 2008. Thymic selection determines gammadelta T cell effector fate: antigen-naive cells make interleukin-17 and antigen-experienced cells make interferon gamma. Immunity 29:90-100.

Kabelitz, D., D. Wesch, and W. He. 2007. Perspectives of gammadelta T cells in tumor immunology. Cancer Res 67:5-8.

Kim, S. H., E. C. Henry, D. K. Kim, Y. H. Kim, K. J. Shin, M. S. Han, T. G. Lee, J. K. Kang, T. A. Gasiewicz, S. H. Ryu, and P. G. Suh. 2006. Novel compound 2-methyl-2H-pyrazole-3-carboxylic acid (2-methyl-4-o-tolylazo-phenyl)-amide (CH-223191) prevents 2,3,7,8-TCDD-induced toxicity by antagonizing the aryl hydrocarbon receptor. Mol Pharmacol 69:1871-1878.

Kortylewski, M., H. Xin, M. Kujawski, H. Lee, Y. Liu, T. Harris, C. Drake, D. Pardoll, and H. Yu. 2009. Regulation of the IL-23 and IL-12 balance by Stat3 signaling in the tumor microenvironment. Cancer Cell 15:114-123.

Kryczek, I., M. Banerjee, P. Cheng, L. Vatan, W. Szeliga, S. Wei, E. Huang, E. Finlayson, D. Simeone, T. H. Welling, A. Chang, G. Coukos, R. Liu, and W. Zou. 2009. Phenotype, distribution, generation, and functional and clinical relevance of Th17 cells in the human tumor environments. Blood 114:1141-1149.

Lockhart, E., A. M. Green, and J. L. Flynn. 2006. IL-17 production is dominated by gammadelta T cells rather than CD4 T cells during *Mycobacterium tuberculosis* infection. *J Immunol* 177:4662-4669.

Martin-Orozco, N., P. Muranski, Y. Chung, X. O. Yang, T. Yamazaki, S. Lu, P. Hwu, N. P. Restifo, W. W. Overwijk, and C. Dong. 2009. T helper 17 cells promote cytotoxic T cell activation in tumor immunity. *Immunity* 31:787-798.

Martin, B., K. Hirota, D. J. Cua, B. Stockinger, and M. Veldhoen. 2009. Interleukin-17-producing gammadelta T cells selectively expand in response to pathogen products and environmental signals. *Immunity* 31:321-330.

Mills, K. H. 2008. Induction, function and regulation of IL-17-producing T cells. *Eur J Immunol* 38:2636-2649.

O'Brien, R. L., C. L. Roark, and W. K. Born. 2009. IL-17-producing gammadelta T cells. *Eur J Immunol* 39:662-666.

Obeid, M., A. Tesniere, F. Ghiringhelli, G. M. Fimia, L. Apetoh, J. L. Perfettini, M. Castedo, G. Mignot, T. Panaretakis, N. Casares, D. Metivier, N. Larochette, P. van Endert, F. Ciccosanti, M. Piacentini, L. Zitvogel, and G. Kroemer. 2007. Calreticulin exposure dictates the immunogenicity of cancer cell death. *Nat Med* 13:54-61.

Panaretakis, T., N. Joza, N. Modjtahedi, A. Tesniere, I. Vitale, M. Durchschlag, G. M. Fimia, O. Kepp, M. Piacentini, K. U. Froehlich, P. van Endert, L. Zitvogel, F. Madeo, and G. Kroemer. 2008. The co-translocation of ERp57 and calreticulin determines the immunogenicity of cell death. *Cell Death Differ* 15:1499-1509.

Panaretakis, T., O. Kepp, U. Brockmeier, A. Tesniere, A. C. Bjorklund, D. C. Chapman, M. Durchschlag, N. Joza, G. Pierron, P. van Endert, J. Yuan, L. Zitvogel, F. Madeo, D. B. Williams, and G. Kroemer. 2009. Mechanisms of pre-apoptotic calreticulin exposure in immunogenic cell death. *Embo J* 28:578-590.

Peng, G., H. Y. Wang, W. Peng, Y. Kiniwa, K. H. Seo, and R. F. Wang. 2007. Tumor-infiltrating gammadelta T cells suppress T and dendritic cell function via mechanisms controlled by a unique toll-like receptor signaling pathway. *Immunity* 27:334-348.

Pichavant, M., S. Goya, E. H. Meyer, R. A. Johnston, H. Y. Kim, P. Matangkasombut, M. Zhu, Y. Iwakura, P. B. Savage, R. H. DeKruyff, S. A. Shore, and D. T. Umetsu. 2008. Ozone exposure in a mouse model induces airway hyperreactivity that requires the presence of natural killer T cells and IL-17. *J Exp Med* 205:385-393.

Rachitskaya, A. V., A. M. Hansen, R. Horai, Z. L1, R. Villasmil, D. Luger, R. B. Nussenblatt, and R. R. Caspi. 2008. Cutting edge: NKT cells constitutively express IL-23 receptor and RORgammat and rapidly produce IL-17 upon receptor ligation in an IL-6-independent fashion. *J Immunol* 180:5167-5171.

Reboldi, A., C. Coisne, D. Baumjohann, F. Benvenuto, D. Bottinelli, S. Lira, A. Uccelli, A. Lanzavecchia, B. Engelhardt, and F. Sallusto. 2009. C-C chemokine receptor 6-regulated entry of TH-17 cells into the CNS through the choroid plexus is required for the initiation of EAE. *Nat Immunol* 10:514-523.

Shibata, K., H. Yamada, H. Hara, K. Kishihara, and Y. Yoshikai. 2007. Resident Vdelta1+ gammadelta T cells control early infiltration of neutrophils after *Escherichia coli* infection via IL-17 production. *J Immunol* 178:4466-4472.

Sunaga, S., K. Maki, Y. Komagata, J. Miyazaki, and K. Ikuta. 1997. Developmentally ordered V-J recombination in mouse T cell receptor gamma locus is not perturbed by targeted deletion of the Vgamma4 gene. *J Immunol* 158:4223-4228.

Sutton, C. E., S. J. Lalor, C. M. Sweeney, C. F. Brereton, E. C. Lavelle, and K. H. Mills 2009. Interleukin-1 and IL-23 induce innate IL-17 production from gammadelta T cells, amplifying Th17 responses and autoimmunity. *Immunity* 31:331-341.

Umemura, M., A. Yahagi, S. Hamada, M. D. Begum, H. Watanabe, K. Kawakami, T. Suda, K. Sudo, S, Nakae, Y. Iwakura, and G. Matsuzaki. 2007. IL-17-mediated regulation of innate and acquired immune response against pulmonary *Mycobacterium bovis* bacille Calmette-Guerin infection. *J Immunol* 178:3786-3796.

Veldhoen, M., K. Hirota, A. M. Westendorf, J. Buer, L. Dumoutier, J. C. Renauld, and B. Stockinger. 2008. The aryl hydrocarbon receptor links TH17-cell-mediated autoimmunity to environmental toxins. *Nature* 453:106-109.

Wang, L., T. Yi, M. Kortylewski, D. M. Pardoll, D. Zeng, and H. Yu. 2009. IL-17 can promote tumor growth through an IL-6-Stat3 signaling pathway. *J Exp Med* 206:1457-1464.

Zitvogel, L., L. Apetoh, F. Ghiringhelli, F. Andre, A. Tesniere, and G. Kroemer. 2008. The anticancer immune response: indispensable for therapeutic success? *J Clin Invest* 118:1991-2001.

Zitvogel, L., Casares, N., Pequignot, M., Albert, M. L. & Kroemer, G. *Adv. Immunol.* 84, 131-79 (2004)

Steinman, R. M. & Mellman, I. *Science* 305, 197-200 (2004)

Lake, R. A. & van der Most, R. G. *N Engl J Med* 354, 2503-4 (2006).

Zitvogel, L., Tesniere, A. & Kroemer, G. *Nat Rev Immunol* in press (2006)

Apetoh L, Ghiringhelli F, Tesniere A, Criollo A, Ortiz C, Lidereau R et al (2007). The interaction between HMGB1 and TLR4 dictates the outcome of anticancer chemotherapy and radiotherapy. *Immunol Rev* 220: 47-59.

Garg A D, Nowis D, Golab J, Vandenabeele P, Krysko D V, Agostinis P (2009). Immunogenic cell death, DAMPs and anticancer therapeutics: An emerging amalgamation. *Biochim Biophys Acta*.

Gourdier I, Crabbe L, Andreau K, Pau B, Kroemer G (2004). Oxaliplatin-induced mitochondrial apoptotic response of colon carcinoma cells does not require nuclear DNA. *Oncogene* 23: 7449-57.

Kabeya Y, Mizushima N, Ueno T, Yamamoto A, Kirisako T, Noda T et al (2000). LC3, a mammalian homologue of yeast Apg8p, is localized in autophagosome membranes after processing. *EMBO J.* 19: 5720-8.

Kedersha N L, Gupta M, L1 W, Miller I, Anderson P (1999). RNA-binding proteins TIA-1 and TIAR link the phosphorylation of eIF-2 alpha to the assembly of mammalian stress granules. *J Cell Biol* 147: 1431-42.

Kroemer G, Galluzzi L, Vandenabeele P, Abrams J, Alnemri E S, Baehrecke E H et al (2009). Classification of cell death: recommendations of the Nomenclature Committee on Cell Death 2009. *Cell Death Differ* 16: 3-11.

Kroemer G, Martin S J (2005). Caspase-independent cell death. *Nat Med* 11: 725-30.

Obeid M, Panaretakis T, Joza N, Tufi R, Tesniere A, van Endert P et al (2007a). Calreticulin exposure is required for the immunogenicity of gamma-irradiation and UVC light-induced apoptosis. *Cell Death Differ* 14: 1848-50.

Obeid M, Tesniere A, Ghiringhelli F, Fimia G M, Apetoh L, Perfettini J L et al (2007b). Calreticulin exposure dictates the immunogenicity of cancer cell death. *Nat Med* 13: 54-61.

Orvedahl A, Levine B (2009). Autophagy in Mammalian antiviral immunity. *Curr Top Microbiol Immunol* 335: 267-85.

Snapp E L, Sharma A, Lippincott-Schwartz J, Hegde R S (2006). Monitoring chaperone engagement of substrates in the endoplasmic reticulum of live cells. *Proc Natl Acad Sci USA* 103: 6536-41.

Spisek R, Charalambous A, Mazumder A, Vesole D H, Jagannath S, Dhodapkar M V (2007). Bortezomib enhances dendritic cell (DC)-mediated induction of immunity to human myeloma via exposure of cell surface heat shock protein 90 on dying tumor cells: therapeutic implications. Blood 109: 4839-45.

Tesniere A, Schlemmer F, Boige V, Kepp O, Martins I, Ghiringhelli F et al Immunogenic death of colon cancer cells treated with oxaliplatin. *Oncogene* 29: 482-91.

Tourriere H, Chebli K, Zekri L, Courselaud B, Blanchard J M, Bertrand E et al (2003). The RasGAP-associated endoribonuclease G3BP assembles stress granules. *J Cell Biol* 160: 823-31.

Tufi R, Panaretakis T, Bianchi K, Criollo A, Fazi B, Di Sano F et al (2008). Reduction of endoplasmic reticulum Ca2+ levels favors plasma membrane surface exposure of calreticulin. *Cell Death Differ* 15: 274-82.

Vandenabeele P, Declercq W, Vanden Berghe T (2008). Necrotic cell death and 'necrostatins': now we can control cellular explosion. *Trends Biochem Sci* 33: 352-5.

von Haefen C, Gillissen B, Hemmati P G, Wendt J, Guner D, Mrozek A et al (2004). Multidomain Bcl-2 homolog Bax but not Bak mediates synergistic induction of apoptosis by TRAIL and 5-FU through the mitochondrial apoptosis pathway. *Oncogene* 23: 8320-32.

Yang Z, Schumaker L M, Egorin M J, Zuhowski E G, Guo Z, Cullen K J (2006). Cisplatin preferentially binds mitochondrial DNA and voltage-dependent anion channel protein in the mitochondrial membrane of head and neck squamous cell carcinoma: possible role in apoptosis. *Clin Cancer Res* 12: 5817-25.

Panaretakis T., Kepp 0, Brockmeier U, Tesniere A, Bjorklund A C, Chapman D C, Durchschlag M, Joza N, Pierron G, van Endert P, Yuan J, Zitvogel L, Madeo F, Williams D B, Kroemer G.: Mechanisms of pre-apoptotic calreticulin exposure in immunogenic cell death. EMBO J. 2009 Mar. 4; 28(5):578-90. Epub 2009 Jan. 22.

O'Driscoll L, Daly C, Saleh M, Clynes M. The use of reverse transcriptase-polymerase chain reaction (RT-PCR) to investigate specific gene expression in multidrug-resistant cells. Cytotechnology. 1993; 12(1-3):289-314. Review.

Yajima T, Yagihashi A, Kameshima H, Kobayashi D, Furuya D, Hirata K, Watanabe N. Quantitative reverse transcription-PCR assay of the RNA component of human telomerase using the TaqMan fluorogenic detection system. Clin Chem. 1998 December; 44(12):2441-5.

Conforti R et al, Opposing effects of toll-like receptor (TLR3) signaling in tumors can be therapeutically uncoupled to optimize the anticancer efficacy of TLR3 ligands Cancer Res. 2010 Jan. 15; 70(2):490-500.

Bonnefoi H, et al, Validation of gene signatures that predict the response of breast cancer to neoadjuvant chemotherapy: a substudy of the EORTC 10994/BIG 00-01 clinical trial Lancet Oncol. 2007 December; 8(12):1071-8.

Brown, M. P., Grundy, W. N., Lin, D., Cristianini, N., Sugnet, C. W., Furey, T. S., Ares, M., Jr., and Haussler, D. (2000). Knowledge-based analysis of microarray gene expression data by using support vector machines. Proc Natl Acad Sci USA 97, 262-267.

Saeed, A. I., Bhagabati, N. K., Braisted, J. C., Liang, W., Sharov, V., Howe, E. A., Li, J., Thiagarajan, M., White, J. A., and Quackenbush, J. (2006). TM4 microarray software suite. Methods Enzymol 411, 134-193.

Saeed, A. I., Sharov, V., White, J., Li, J., Liang, W., Bhagabati, N., Braisted, J., Klapa, M., Currier, T., Thiagarajan, M., et al. (2003). TM4: a free, open-source system for microarray data management and analysis. Biotechniques 34, 374-378.

SEQUENCE LISTING (531 sequences)

SEQ ID NO: 1 - DNA, 80945 bp, Homo sapiens
ttccgaccaacactgaccactcctctaattataacttatcctcttgtctcttttctgtgggtatttctaaagcttactggtcttgttgctctcttctcttggcaaatttatctatgctgatggcttcagtgaccatgtcaatgttaatgatccccaaatcttggtctttattcctgatcactcatgaaccttctaatcttataactccacctgttctcttagatctttgctatatgctaacttatgtctaaagccaaagtcattgtcatactgactaaattgtgctcctctccaatataccattttaaaaaacactagaaatttctttttttatatgtcaaacatatagtcatctttactcctactttaaaatgtatttgaagaaaggattattcaattgtattatttattctttgttttcttggtaaatgccttcctttctattatctgttgtcattacctgcatccattcacccacccatccatccatccactcaccatcatgccctggttaatcttcctccagataaacctacttataagtgatctgtacaaaaaacccgcagtgccaattttcacttgattaagtatattaagtgttcctgaatatattaagcagttccatctgatataactgttagttctcatctgcttctaacttgaattctctctaaattaagcatcatgtgccctaggctgtgctctgttacaaaagggtgggatcggtacagttgatagcagctgtactacgtcctttgtttgttcttatttgggttgggagcagttccatggggaataaagaaggtggagagaaacatcccactacaatgatagtttatttaataatgtcctcatgccaaggtcatcctcactcttatgaagtattaattcaaaatctctagttgtcatttctagattttgccaaagagttacttcccttcatgaggcacagcttccaacaatgtagagcccttggctgctttacttggagagtctggcttctgtgccaaatatatgtatcattctgtgtactttctagctgcagtctctttaaaagccaactgtgggtaatcatctcagggaataggcatctatgttgtaacccttgaagaatgttagcaatcttttatttttctccataattttaaagtcttgtttcataagcttatttattctctgacttcatttggcaaatattgtttgacaaatattcttgagctactaccattggataccaggtattttgtttggttctgagaataaaatgtgaaatctaataggcccacactgtgccttcatagagtggggaggacagataccggacaaacaattacaaagaagtttgaggagtataatgagggaagtacagagttctgtggaagcacttggtattagcatagctatctcagttccactacttgctggcagagagatcataataaagttgcttaaccactcaaaggttcatttcctcgtatgtaaaactgtggccaataatagcacctgcttcatagattatttttattaggattaaatttttaaaaacacatttagcgcagtatttggcacatagtaagtacccaataaatgttaactgcaataataaaataacattaattttacattccaaatcattttattgcattaatttatacttctaaaactttaaagtcgttttttttaattctcggcagctatattttttcacttctgactcaaggcttttaaaacttctttatgtttgtctattaattcagttcctcaggcattattttattcaacaaatatttattgggtgcccactatataccagactctgtgtcaggcactgataataaaatgctgagcacaacaaataggatcctttccctgaggagcttacagtctactgaaacggatgggcattaaataaaccatcacaggaagaagtacaggatcacaaatggtctcaacataggtgtaagtacatttaaagaaaaaaagataatgatctttaacagggcaaaggcaaatgagattcaagctataaaattagaactagtcctaatgtcatgaaaatattatactttcttctaaagccccaatcctaaaataatacggattaatcttaaaggctagaatatgtgtttccaataagctacttctttgctctataaggtagctgaaaaaaacatactatttattacaattttgcaatgggctacattattcaaataaggacagtttaaacatggtcacatcatttaaaatgatagctacacgaaaactctgttaacattagaaatatactattctatttcaatccaacaatgccagctgcaacatacatgtttgttttgccagtgaaaacaagcagacacattaatgaatacactgatgttttatttaatttgtttccaggccccagctcaaagtgctttaaaatgtggattctggaatctaccctaactgtgaaaactgtggccagttacttagaatctcagtgctcagtttctttatttagtaaagtggggttaacaatagtatctacctgaagtgttagaagagaatgtgacatgtgccaggtgtggtggctcatgcctgtaatcttagctcttatggagggaggggtaggaagatagctggagcccaggagtttgagacttgcctggacaatatagcaagatcctgttctccaaaataaggaaaaaaaagagacaaagaagagaatgtgacatgtattgagaacccagtaatactatgaatgaaatggtagctattgacgctaagcttaattttttttctttttctttttctgtttttttgttttgtttctttttgttgttgttattttgttttgtgtgtgtgtgtgtgtgtgacagagtttcgctcttgttgcccaagctggagtgcaatgccgcgatctgggctcaccgcaacctccgcttgctgggttcaagtgagtcttctgagtcagcctcccaagcagctgaaattacaggcatatgccaccacacctggctaatgttgtatttttagtagagatagggtttctccatgttggtcaggctggtctcgaactcccgacctcaggtgatcacccccactttgacctcccaaagtgctgggattacaggcgtgagcccccacacccagcctctaaggttaaatttttaaaaatgaaggatatgacttagggtgaccagactccctaagttgctggggactgtagggtttcacctgaggaagaacttccagtgagtctcgtgaaccaatgatgaaatgtatgatgaatcaagaatcatgataaatctaatttggaatacttgagggtcatgaattttagtccttgaattttgattggttaacaatattttagtgtttgccatatcccagaagcagaaagccagggaataataaatgccgcctcaagcacacctagaccagtctactccttcctaaaataggcagaatttaccacctatgctttaacaaaggcttgaataagcagagcatttagagaggagagttcaaggtaacagagagaccactggtctttagatatgtcctaagagcatcccaataggtatagaatggagaataatgctaaattaaattctggcattcttgcttttttcttattcttctcatggaaggtatatatattatctgatgtattgcttcctttataaaccttgaaccttaatatggtgtctagcaaatgtttggtttttagcaacaaattgtagagttgaatatttcttaaggctgaagagataaactttttatattcatttttttcactttacagatcagtgcctattgcaaatttatagatcaatttaaagagaattagaaagttccaaagtttgttgtcacacaattgactttgcaggttggtatttattttatcaaacatcacttacatgccctttacaaatctagctttgggaaattaccgtggttagttttcttagctcatgcttcacaatgtatgcagttttgccaattgttgtaatgtcaatatgggaaatataatatgctaaatacagctactgtatttagcaactgttccagtaaagcattctccagctgtctgggagtcacaatccgtagtcttaaatagatgtatctgtcatcagtttcattagcttcggattatatgtatcatctgttggttttgggtgtaaactggcgtgtgcaaatgtttttctcataatatatttttttaaaaggcacacaattccatagatattcattttattccacaaattcagaatccacaaataattttgtattttaattatatgttatattctcatttatttgatatattattaattattatcatctatttcatttattatatccattatattttcatttctgatgccagaatccacctgtgactattaaagatgtagagaggtctgtttgccttacatcattccctagttcttgctgagcatgtacttaatgggaagctgcagcagaggactgggacagccttaaattgttggggaaatggtaacggagagtctattttcatcaaattgagaggctgagtgattaatgtacatgcaataaacttaatagatttgaggcagtttgcacggtaagtacagatgggctaatgacatacaaaagtaaaaggagaaaatctttattaaaagatcctacaacacagaaatgtataagtaaagacatagactttaaccctgagcttcctcgttcacaagggtaaaagagaaaaacaggacagttacttcactttaattgtttagaacaatgactcccaaattagtactccctaaggaaagttaaagacaagtaattaggacctgggtatctctcatccctgagtcaaacaaagcagctccatgttcacctgttttccatattagaccagtttccgtattaacagcactggggaatgagagaagggaaggtttagtttgtagtacctgagatttctggggtgtaaatgtacatactatgtccaatttcaagctatcaacatgacataaccaatcacaatgttgggaagagatgcgcacagttgactctcatgaggtaaattcttgtctggatgactgattggcctctttagtgcatctgctgtgcaaatgacaattaattaccagtgatatgttgatcactccaagtatatctctggcttctctttctctccttagcctttagaatcattttctaattacctattggatatctttattttcaggttcagcagacaatttgtactcagtatgtccaaaaccaaattcactcccccatatacacacatatactcctgaattccctctctcttaatggcatcattatctgcccaatcattgacaaggaaacatgggaggtatcctagaaaactttaccttccacatcagttgagcatcaaagactattttttttcccaaaaaatacttgtcaaatcaatcctattctctccttctttatctgtactcctttagttcagaccttcattttttgtattataataacctctctactggtttgaccttttcccattcatttccaaatttttatgagttattttaccaaatatggtttgtataacaaaacactcattgaaaactactcaatgaaaatccgtggacctcacagacactaaaatgttttgctacagtttgcttccagcctattttttcattttcatctgctaatgaatcttctataataaagatgttaaaaaataatttctgctccttctcaaccacaagcttaagacagatatcacaaattaatcacagccaagctttcacatggaataaggatatagcttcagaaatctcatcattcaaccgtggctttcaagcagctacctacacactcacaggaatttgttcgtgaaaggcagcatacttggcacccatttatcctctcttccagtttttataccatagcaatacttgtcattcaaaggacacaccatgtggaattatgccatcatgcctttgaacatgctattccctttacctgaattatcttccccattcatgtttttcatatatttacctttcatctttcaaattttctctcaggtgtcactttttctttgacatttccatgacaccgtccaatcccctggctcaaagagatgaggagaatccaataagtcaataagaaaaaccttacttcatcaatagaaactagatagaaatataactctaaagctctatatcctttctttctatgtcttttaaaaagaagcaaaaacattgaggctataaaatatagaaaacatttttaaatcagaaagaaagaaatatatacatttcaggaagatttttctaccactatatataacgctatgtctaaataggattttcttacaaacttctgagaattagaaaaaaatcatttcttgagtattctttggaattgtcatttcaatggtgatgagaaacatgcatttgaaagacaatatgaataacaatatgctttgtctaatgtctgctctcagtatttgactggtatacttggaggaaatccatgaaatatttgaccataaaattgtcaacactgcaagaggattttccttgcctgatgtaaggttgccagatatttagtttgaactcaactatatggataaataagaatctccatctaagttatgaacaattattgtccttgatttcctattccacatcaccagcaatgatcctaggttcttaaatattcaccacagaaacaacctaagtttatatattttgcagtatagactttttttcccttctccttccaaggctcattttttaaattcattattttctcatttcttaaatcagagattcttaggatgagtttatggtgtccataaacccttaacactacatataaaacatgcaaaatatatgtatatttttcttgggaatagtatagttttaatattttttacaaaggtatgtgccacaaaaaacccatgaaagactgatccattaaaagttgctttctgttcaatattccctcttgaacaatattttccttttattatttgctatgtgctcaatcttctacaactgtgagagcttcatttcccatttatatttagatgatatcctgattatggacaacagctactacactcagactcgctcttaagctccagatctgtatttctaaatgctactggactgaccccttaacctcattatgtcattccaaaataatgactgaaggccaattcattggatttggcactggaaagacaaggcggcctgccttcaaagacatttttatacaactatcctttactgagcacataatgtgttctaggaattgtgctacatattttaccttaaaaattgcatcccatttaattctcacaacaaatctgtgaggtttacagataaggaaattgaggtttcagagaaattacataacctacttaaaattatgtaataacttagttgggaagaccaaatttgaattgattttgtctgtctctagggtccaagtttttatcactatgtacttcttttaatagttcatggttggaaggaggtcattgcgatagcatttacactatggcaagcacaggatcacctactacttaaaaatcctctgcaattaccagtggcctcaataaccaagtccatactctttagctcagtttataatttggcctcaacctacatctcagtcctcaattgccagcatattctccatctacagtctagcacccagttacaccagactattgatcctttcttcaatacatcatgttctcctctcatgcttctctgccttgtatatgtcatccagtaggctggaaattcacttgtccctcttgtcttcttaggagaattattttattttcataacctattcaaatgagtgtcaccttctaagtaattcactgaggcaaaattagtgaatttgcctccctgttctcttataacacttatgcccttaccatagggcttggatgtaatcatttgtttactgatctttctccattcctagataaatcccttggggagaggagctatgttaggtttctcttgcgccagtgatggtagtgcattacctagaacatatggcaggttattcagtaagtgtttgtataatgaatagtattcaatctttatctgcctttgatgttgagcatctttatagagacagaaaacctcaatataatgttatctttgatatggccattttctgtatacataaatatcatttaagtaatattacataaatgctccacaaaatatggatagcttttacatttttatgtatacttttgacattgttttctagaagtttgactttaactcttcaactgtttgaccagctgacacatatatggaggggaaactattatatggggctatgaataaggtgatattttctaacttgcttgcttggtaaaagaattttttgtgtaagaaatgagatttcagaaaagtcacaattaaaaaaagaaaaaaaaataagaaaagacttggaagaggtatgagaaaacccatgacagtctgttcaagaagaagatggcaatgattaatgttggagaggggtgccaacgtaatacaatgggagaaacaatagtcttttcagcagaagtgctgggacaactggatatccagatgcaaaagaatgaagttgtacccttaactcacaaaatttacaaaaattaacacaaagtggatcaaatatctaaatgtaataaccagaactacaaaactcttaaaagacaatatagagacaaatttttatgatttcagttttgacaatggtttcttaaatacgacataaaattgatgaaataagcaatgattttaaaaaattagacaaattggacaatgataaaagtacaagcagtgataagcataagcaattatagaaattacataaattggactttatcaaaattaaaaacttttgtgcatcaaagaacactgtcgagatataaagaattacactgtcgagtataaagaaaacccacagaatgggagaaaatatttgcaaatcacatatctaagagtctagtatccagaacgtataagtaactcctacaactcaataataaaataaccgaatttaaaaatgagccaagagtttgaataaacatacctccaaagacaataaaaaatggccaataaacacaggaaaacatgctcatattatggaaatcaaaaccacaatgaaatatcactttatccctactacaataaaaaggacaacaataacaaatgctgggaaagatgtagaaaaatttggactttcatatgttgctgatgggaatgtaaaaaggtatagccacttggaaaacagtttggcagttcctcaaaaagttaaacatatagttatcatataacacagtaattttattcctagatatatacttaagagaaatgaaaatacatgttctcaccaaaacttgtatataaatatacatagcagcattactcaaaatagccaaaaatagaaacaacccaattgcccatcaactgatgaagggaatagacaaatgcggtatatctacacaatgaaataatattcaggcataaaaaatgaagtattaatacatgctacaacatagacgaaccttgaaaacattatggtaagtgaatgaagctaataaaaaaagaccatatattgtataagccacccccaccccggccttttttctgagatggagtctccctctgtcactcaggctggagtgcagtggtgcgatcttggctcactgcaacctctgcctcccaggttcaagcgattctcctgcttcagcttcctgagtagctgggattacaggcgcccgccaccatgcctggccaatttttgtgttttcagtagagacagggtttcaccatactggccagcctggtcttgaatttctgacctcaagtgatctgctcaccgtggcctcccaaagtgctgggattacaggcatgagccaccccatccagccttttatgagcctatttatatgaaatttccacaatatgccaatccacagaagcagaaaatagatcagcgttttctaatagctggcagaaggaggaatgggtagtgactgctagtgagtatggagctgctttttgggatgatgaaaatgttctggaattagtaccgatagcttcgtaatcttgtgaatatactaaaaaccactgaactgaacactaaagtgataaatgttatggtacataaattttatttcattttttcaaaaagtactttttacatagcattgttgtaagactaaattaaagaaagtatgtaaagtgcacaggacctgtaatcgataaatactaattcttattttttttttaaagaatcgaatggtaaagatggctttcattcatttgggggaattaaaaataattacagtttatatgagatatggaaagaggatacaaatctgttaaaatatttttttcaaaatacttcgtatagggctaatgaatcaaagggaccactttatccacattttcctgactagtgaaatttgcgctaatgtaggtacaccaagctgtacttcttataagtatcactacaataacaaacacctagggatggacacagcactccatccaataactgtgtgaactcattacctaattattattataactaatatgttggttgctatatcacataacagatatgaaaaaatacaatgtaatcacaacaacgtcagagtttcatatcatcgttaatagagctactggctgtagcaaaaatattttaaattatcaaagctaacctataatcttttcacaggtacaatatgtagtggtgaacatttaactttaaatagcacagcacattgtaaaagtcaccctatgtcataagaagtgtataaaaataattgtttatgattctacatccctgaaaaatgtgcatgctgcacgaaatgtttaatgtgtccttgaccaaaagggaatacaacattaattttgttttgaggacaagtggactccagacaaaagacaaaaataggtaacttaggtagatacaacagttttagaaaattctgttcctgaggtggtgggatttttagggaacttacctttctcaagaacataatttcaaaagacactctgtaaattcatcaaagtttaatgatgaagagacacaataaatgttatgaagtttagtggtggatactttggaagtgaatgccaaagattacaatttagagaagaccacaaccaagaaacagttaacaaagttttagttgaatgaaaaattttaaaaaagtacatccaatttcttcaaaaaatttgtttcttctgcgattccaggtttaattttggttatcccatgacaagtggttcacaacactgggaaaagaaaggaaaaaaaagaaaaaatatattttatttgcatagttcatatttttaatattaatgtacatatctaagaatgttttcttcatagagctttcattctacttttgttttatatgtaattaaaattgaagaggatttgacatcccaaatcctttttaaatgtttttctgtatatggtcagcagaaaacacaaaatatagtgatccttccacctcagtctcctaagtagctgggactataggaacgtgccaccacacccagctatttgtttatttttcatagagatagggtctcactatgttgcacatgctccagctatcatttattgactaattctaaccttaatgaaatagttcctgatttttagatttacttccaatttccccatcccatcttaaatactaccacaaactgttctgaaaactctttcctaaatacacataagtttccttctcaagaacccataatttctccttgttcatcaaatcaattttaagtatcaatcctaagataccccatcaactaatctaactttgctttcttatctaacggcattttccccattccctaacgcataccttccacttcaatcacactaattttcttcatttcctcaatatgtcagattcatacttctcactttatcatgtttaattagaaaacctacttgccacttacttaaattgtacccattctacaagatccatctcatgcagtacttgcttgtgccatatgttcttcacaataacttaaattttatcttgtattgtttaagacgtttaatcaataagccacatttctcatgtaattgaagaataggctggtgaaatcttaagtgcttaatcaatgtgcattgaattgagctaaatttatatacttaacttgaatttatatgcttcaatattgtactgttgaggttaaacatctttaaaattactttcatattattttatattatttggtcactcccaagttttctcagctacagagctcatgaggttgagaccacagtgagctgtagttgtgccactgcactcagcccaggtgacagagcaagatcttgtcttaaaaataaataaaaataaatgacagatgaaaactttattccatcatatgatgtaattttatacacgtggaagtaaatgaataagctttcatgcacagagcactggaaattttgatgtagtttattctgtccaatatataaaattactatataaaattacctaggaaagtaatgagcacttagtgtaattctcctgttttctgagttcacctattgaggaaaactgaagagtgttttcatagtcaagtttcaactgaatttaagtcctgagggatgaaaactaaagtatatacacacatgtatattttaggaaactttcttaggagatacacacacacacacacacacacacacacacacacctcctaagaaagtctcaagggaaaaaatgtcagtgggatgagcccttttaggagaagcagaataaaagactgactacaaatcaaaaagccaaagaagaagccacagacagaaatggagacaagatccagaagccaggctgaaacaggagggcaacaaatcaagtcaggaaataactgatatgaagcacatcggtgccttaatagtggctgaatatgtgggctagtttaaaggtgaaaaagtctcttgacgccataaatataacacatatttctaaaaagaaattcattgaaaagggggaggagaattattttattcctttagaaagtataagatcaaagcacagagcaatatttttccaaatctgctcaaaatcttgccagacatggtgttatgtcagtccacttccacttacagaattagccatagtgcttctaattatgaccactgcaaaaaaagtaaaaatactagtaaaatgtaaattgaagtgaaagctattcatttataggaaaggtatcatacaaactcacagacattcttagaactggagatttataaaatttaggtaccaattgaatatgcaattgtttcttctgcattatttgcccagaagaaccaatacttcacaaactgtgtttagactttattagctgagcaaaattaatgacaagagaatgccacgagacaattttgatagttgcttttcatatcatgaatacttatctttcaaaagaggaagcaatgttaaatatgcttaatatggtttaatcctctcaaagactttgtaaggtatcaatgaaacttgcacatgtgtgtcagttaggttttagtacaggaaacagataagtttcaggtatttcaagtaaatagggatttaaaacagggaataaaatgcttactaaatctttgggaaggctagagagagaggctctaggctgggaattcagaaatgtttccataacactgtagaactgacttattagagaaagatgacctttgcttcaatcagaaaagtggggacttcagaagtcactataaaatttattgacttcaaaaacacaccattgtagccacaattaagagatcagggagccactactgctcacacccctacagcctctcaaaccctagaacttggatgctggaacccatcacagaaaactcatatttccacaatctcacttattagcagaaaacaatggaagcagcaggaagatgacctccacttgacttttgcttccaaatctcaacaagtgcacctaattggatgaaacttatttacatttggaagtttaatggcacaggaatctgggaaaatttagtttttagctttccagctgctgtagtatagaaatacacagaatggaaaagtgcaaatggttgccagttggccatatccaccatactgagattcaaaggttttagaaatttcttatccaaggtcacagaacttgtgagtgctagagcaacaaacttgaattcaaagattttggccacttgcccagtgctctttccactacatcagtctacagcactgattactctctgaagacatttgccaaaggagacatattttcaaatcttgtgctaattatatttttcactgaagcattaattcaggcatctgtgaacattgttaccttttagtcttatgtcaaacctagttcttcttccaaactcagacttaatcttattttacagtaattacagttaaaccaacactgctagggtttaatacctttgagtatttttctcagcaggcttgctgcttaatccatttaatgtcagaacaacacaaaccttcttattaaaatgggggaaaggacgttattagagactgcattagtggtcttttcttctttggggtaaaacctaccaatatggcaatatttgcaccttatctttattttgttttctgctgaccacatacagaaaaacattaaaaaaggaaagatttcagatgttaaatccccttgaattctaattacacataaaagtagaatgaaagctctctgaagcaaatattcctagatttgtactttaatattaaaataaaaaatatgaactatgcaaatatttggacaaaatgaaaaaatataatgcctcagtaatattcatattcaattaaatcatcactttcatttcaaatgcactttaaagtaatttggggaacatattttaaaatgtacatacaatgacctaagtacaaagattcctaacatataccttaagagaaaaatagaaattactacctaacacttctgattagacttaagcaacaatactatgttaaaattaaagaggtgattaaattcatataaataaaaggtacatatcatgattgtagttagaagagatttgattgcactctttaaacaaggagataattattgttcaaaagttgttagatcaagtggatctagtagttttgtgctaagagcatatagaaaagaatataataaagaaacaatgtatgtggttgttaaggatcaaataaagacgttatgtgagtcttgtgtaggttagattacatcagtatcacagattatttatctccacatattcattagatacagaatgttaactttataagagttggcaaatttttaaatcaaaaggaactattgtattcagcacacaaagcagtgaaggctgtgattaacctcaagagaagtttggggtgcttactagagaaaacaattgatcctgagatttttctgaacatttctatttgtcattggaatccgtcttttgtaaaagactgttttcactcctgaaagtcattatgtactctctctgtgtacacacacacacacacacacacacacacatacacacacccctctatatataatatacacacatataaatgttgaggggtatattagagagatcacacaataaggctttttcctttgctttttacataggaaactaaaataataagttcaatttaacttctaaattcattcagattagaaagaaaaataattaaaaattgtgatagtattttttttgttgaaggatcttttacattaaagtcagcagtattatttggtaagtgggctacagagtagaacttaaaaaatatatccctatctcagttatcccacatttttagtatcttataagaaatgaccaggccgggcatggtggctcatgcctgtaatccctgtgctttgcggggccaaggcaggtggatcacctgaggtcaggagttcgagaccagcctgaccaatatggtgaaactccaattctactaaaattacaaaaattacctgggtgtggtggcatgcacctgtagtcccagctacgtggaaggctgaggctggagaatcgcgtgaacccgggaggtggaggttgcagtgagccgagatcgcgccactgcactccagccttagtgacagactgagactccatctcaaaaaacaaaacaaaacagaaaaacaaacaaacaaaaagaaatgaccaaagaccataagttgtaaactacagaagttgaagttacctttataatgattttatatatatgtaattatatatattatttaatatatgtatgtttgtgtgtgtgtacttgctttttaaacagacttatgttggacatatatttcaatgtcaaagacagtgcttttcattattctttaggtaaaataatgaggtgtacatgactctagtaagagctaattggaaaattataatgtttgacactcctttactgttttgttttcttattttttgactattaattaaaaggatgtgtagaaaacatgaaaaattaagtattaatttcatggtgacagatatttaccatctattttttctgagcataacatatagtaatatagaactcagaaattactggcttaaatcaatgctattgtttattaccaaattaaccattattattctagtcatctactgaggagtatagtttccaaataaaacttaaattgccacttagagacttgaccctaaagatgtaatgacataaagtgctcagttttgagaagtatatttcactttgtgtactgatggattttcctcatcttgttgagcagatactaaaaggtaagaaaagggctattaagttacagctattaagtactatttattattattgaaaaaaatatcatctttaggttgactgataatgacatttcttttagaaggattgagtgtttgtgtgcctaaaaaccacgacctacttcataactggctaataccttcagtatgaacaaactttttaagaataaactgctgtatgtgaggctacttcttttattaatatttcatgtagggcatgtttataaatatttgagaaaattctatcagaatgtcaaccttttttatatcctaaaataggcaaatactaattaaaacaaaatggtctgggggattgaattaccctctactgacctccatttttctcatcttgttaatgcagttcttactgaaattaacatttgtctgaactgttcaagagtaactaaaaaaaaccaaagtttgcattttatatcattcatttactttacatatacaatcaaagcactctaacaggttacagattggtgtttttactcatataggtgtatgtcaactttcttttataggggagatttgcttcaaagaattatacaaaaaactggcataaatatgaccactcacaaaatgtgtttaaataagtaaataatatggaaaaatacaacacaaatatgtaatgaatatttgaaaaccctggtttctgaagagtttagatagggattgtttacattataatctacttggtatttctttaaataccaatgtatcccaaaataattattcgattcacatgcttttctctgaaacatatttgctttatgtaatttatttaaaggctcagataaccagaatgaattcaacctaacgcaaggattaaaagaatgtaagagatctgtccaagatctgggaatacatcgaatccttcctactcattttcatcagaagccctcgcctctgtgaagacagatgggagctccatctacattcaggcaggaaggccactcaactaaagtttaaagttttacaaggaaaattcctacagcttgctttaggagggaagggtggagaacattctgttttacaggacactccaccctcagctatatccccttgattaattatgtaaccagatctccttcatcaacttaccgattaggtaatggcaggtatttctgatgcttggtatggggtctgagtgaggagggtcctaaaaatattacttatgcagctgttttgcatagcattaaagtgaaaagctttaacttgcagtacaagttaacatttgttccagacttttttttttaaactattattttagcatgtaagccttatagacataaatcctgtctactgatacattataaagtctcagaaaagtcagtgattatatacaggaaagtagataaaggagaaatttcaaatgcataagaacaagcaaaaaggtattcgtaaggtattagaaactattagcattttagtataaataactggtgaatacagcaaaatgaataatttgtggttagtataaatcagctaaattcttgtaatgcacaactaactacacatattcttcagcccacggaggccatacaatggagatttgggattctaactttgttttcaaaatggagaagtgcagaaactttgaatcttttaaaatttatcttccatctgtttcctgtaatatcaagatttagagcaaggtctaaagctttatcttacgtaaaagctgggtgcctaatatgtatctgtcctgacctcccatggaaacaattatcaggcttcagatattttgtctctcaattttttaacttgaaagtacatggctatttatttttgcacttattttttgtttttattgtgcaatttttcaacatatggcaaagttgaaagaataccacaaatgtttgtatacctttcataattgtgtatatgtgtatgtgtgtgtatatatatatgtatatatgtatatatatatatgtatatatgtgtatatatatatatgtgtgtatatatatatatatatatatacatatatatatatgaatgttgcagcatgcatttcctgagaataaggatcttctctttattctagaggtatatacctctacaggtgatagaggtatataaccacaatacctctatcacctgtaaaatcccgattccaggacacaacatagataaattaaataaaaatttttgtagtggagccaaggatccgtaatttttacagttctcaagtgactacaatatgcaacaaatgttgagaaccactgtccacacattaattaaatttgttaaatattttcagtaaagaatacattttgtttcttaatatgaataagaatgatagccttttaaagtttagcaaatctaaattatatattttaggtcagcattttacaataatttacatttccttaagctgttcttatcaagttaataattttctttgttaaataaatgtattttatcttaatttcagtttcttctatatcatgatttaaaatgcagaaagtatgtattatgtagttttcaaatatatttatctccaaagttaaatggattttagtaaaaatgatatttatacatatatattttaataaaatgtttaataaattagacatgaatcttagcatgtgaaacataaaacttttttataactttccccataatcaaacttcaaattcgtaagaattaaaagtccggaaagaaagaaatcgaaatccaaacttactgcatgttaacattttaataatgtactttcatgtgttaaaaacctaaatgtttcttgcaacaaagcattatccataagtgaataaaaataattttgactaataacaaattattcctatcttgtagtttctttgtcagaattaagattagcattatctattaattacttctctgtggcttctatgacattgttgtatccaagcaagtaaagaagacattaagcatttagaaacagcccttagatgtctatgtctgttcttcagtgttaggagtaaaagcaagcaatgtgtaaactgattatttttaataaatgaatcagaacagttcaaagtcagataagttatacattttagactggggcagaagtcacaagacccagattctaggctatgattagcagggcacttgatctctctgggcctgaagtttctcacctgttaaatgaaggatttagttatgccaaaggtcccaaactttctcagttcacagcattcctagtgtctcagtaattttttcatggtgttgcaagctaaaagaaacacctaacagttccatttattaaacagttaaacccaaacttatgtttgtctatcctaacaacttagtagctatttaaaaaataatatacattaacattttttattcttaatgggatgtgcacatctgttgggcacttcataacttctcaaacttaggaataaacttggaaaccgctaccctcattcctgttctacagtaattttcccatagtccttgtgttttattacagcaatttacaaaaacacagcctcacaaagatacgatgtcaaaaggaatgaagtacaatttaatgtgtagaagttctgaactacctcaagatagtggtttgcacggtgtccaactgatgtcactgtgttggccttgaaaatttaaaatatcccatgatagtgcccctgtgagtttgttgtggtgctcctggggtgcctcagtacatagtttaggaagcatggactaccctctgtaaaatacttcatatagctacaatgtgtgttgtaaactgtaaaagacaattctgagggcctgaagtaaggagctgcagaattgaagaggagattaaaaagtgatacatgttcagtctgcatgaaattccccttcctccccaggtcacctataaaatgcctacctatgcctacctataaaatgcctacctatgcctcaaaactcagctcaagctccctcagggaggttaccaagttacccttaccaagttaaatccacctattatacattctcacagtattcatttcacagtacttgtcccagttgtaattatacattcatttgtgtaactatctggttaattcttgtctctctcattagaatgtaagctctaagaggaaagaacatgtctgatatcactactgtaacccacagtgtctggtatattataggggctaaaatcttgcttagtgaaatgaactgtgatagaataggtttagcattcattttgattattttcctttattcaagaacagctgatatttataatagcattcctaaaacatttttctcatactatttcgcaggagaaagaaacccatacacatacagctgcatctgaaacctcagaaactaagctcaacccaattgattaaaaggatgttctttggataaggtaatcaaatgttcaccgactcttatagccaaattaattattatgagataaaaatcacgtaactacaaaaaaaaaaactgctcacaaaaaagtttttaaatcttagcagatggacacaaaccatactttgagaaccatgttccacagtgccaatacaggaagtttctagataatggcagctcattttttaaaaatggcactacactatactgtattcacatgccagcaaaactgttaaggtaagttcatgtcactattaaaataaaatgaattctgggaattttgttgatattcaattttaatcttaattatgcaaagatctgttacttaactaagactatgtaacataatatagcatatgacttctggataatgaaaataatcctaaacttaaccataaaaaaataagggtatgaaagtcaaaataaggtagaaaatgactgcaccaaatagccaacaaccttaaaaagggtaggatttttttaaatcactaaattaagattggttcattgcatttagtacatctcttttatgaagaggagttataagctacagaatcaataaattatgttttgatataaatttttcacccttaaagttcctagctaggaggaaattattcttttacacttacacgttttagatagaatggctataagtaagcacagataaatgaagaaatgaaagagaagggaaaaatagagatggttgattctgcctctgcaattgctaattcataaacatcaaactttcccagtgtacactgtcttctttgggaatttgctccatctttttccttaaactgaaaggtggcttactgaggctatcactttcctaaaggtctccccaatactgcctaattattttctcttatcacaggatacagggtggatgtccatctacttccttgttgtcacttcccagatcactttcactttatgctcttctaaaattaaaacaaagatcatcgaccacaaaacacaattgttcttttgtagctcatgctagaataccctctttgttacatctccttcatttttctgatccaaaatttagtagcctactatatctcacccactgtccttctttcctccagctatggtagagaactgctcctccaactttatgtacatttgaatcacctgggagttcctgtgaacttcgggttctgatttaataaggacacccaaagagtctgcatttcctgtaactctcaaaagaagctgtggagtactctgaatagcaaagcactgtaagtgctgtttctgttagtatctaatctattagtcctaatctcccatttatgctttggcactcattccctcctgctttcggtatcttaatatctatcattccttcactcttccctcaggttccctacatagtttatctctaccccctctaagccgctcagtatcgcccattaaagaactaaaccaaaactagaaaaccctcatttaacccttcactccccctacatacaatctgatgtgtctctcatccacagctaaacttggaagaaaaattgcctgcttgaggatgccattttgttatcttcagctcaatcctgtacccacttcaatgttatttgcaggcccattaccccaacactgcattcacgaaagtcatcagtgactacacattgagaaaacaagaatgacattttcagttctcaactaatttgaatttctcaacagtattcaatattgttaattactcccaatatttttccacatggtcctccatgacacaatacataatagtccccttattatctatattcctgtctattgtaaagacttcccccgcacaccaaaaaaggtcaaggaaactcctagccttcaagtctcaactcaaatctggccttctgaagccttcccaactaggaaaatatacagtcccattggttgtctaccagttgtctaccagttaattgtaattcttagccacaagttagctgacccaccgtctctcaaacaggtgaagttaagctcaatatttggcatatcttgatatactttgtacagtctagctacaataagtttgcctatgcacgaagatggctaccggcgggggggggcgtccttacgtcctacgtcatcacgtgccgggatgagggtggggccctcaaggaagacggaatggaatccagatgggcgggggcaagcaggacggggcggggctacgcgggatctgggcggggcggggccggtgaggggtcgggggtgctcctgctattcagccggtgcgcgcggcggcgggaggcagtggctggggagtcccgtcgacgctctgttccgagagcgtgccccggaccgccagctcagaacaggggcagccgtgtagccgaacggaagctgggagcagccgggactggtggcccgcgcccgagctccgcaggcgggaagcaccctggatttaggaagtcccgggagcagcgcggcggcacctccctcacccaaggggccgcggcgacggtcacggggcgcggcgccaccgtgagcgacccaggccaggattctaaatagacggcccaggctcctcctccgcccgggccgcctcacctgcgggcattgccgcgccgcctccgccggtgtagacggcacctgcgccgccttgctcgcgggtctccgcccctcgcccaccctcactgcgccaggcccaggcagctcacctgtactggcgcgggctgcggaagcctgcgtgagccgaggcgttgaggcgcggcgcccacgccactgtcccgagaggacgcaggtggagcgggcgcggcttcgcggaacccggcgccggccgccgcagtggtcccagcctacaccgggttccggggacccggccgccagtgcccggggagtagccgccgccgtcggctgggcaccatgaacagcagcagcgccaacatcacctacgccagtcgcaagcggcggaagccggtgcagaaaacgtgagtgtcccgagcgcgtcctcatcgcgggggctgggcgctcaggcacgcgggtgcgggaggcagccccaccccgcccccaaatccctgcgatcctgggattaggtccattcccggcactgcccgtggaatcgaggtttggaggccggctgggagacagaggacttggattctcccgttttcaatgattgcattttaaaaattgtcctcccacccatcctcttcccccgcaccagtgcatacacaccctctcacatttgcaactttgttctttctgatttggtcctgatttgttgacagctctgatctgccttgggctaatggattagttagtataaacctgtcttgaaatctccttccacttttcatatccgcatgggttaggttagaggacggtcttaattctcattcttcgtagagtttggtaaggcgagatgttttaaagagctaaacacatgctgacttttacgaaggggctgagtgcctctaaaggtactttttggtccccaccaactggctttgtgttgcgctcatatttacttatttggcagcaattttgtagcgctcatcgtgaccatatcggtaaagtggatagaagtggtagcaggtgggagtggatgcaacggacaggatacggtggaggatttgtattcttcagacatctttttcggaagcttgcttatcacttttggggtggctttagggtctgtaaaataaaagatttagaactgcatttgagagaggttttcattcttaacatctacctctaattcttttccccttcaaagttttcttctagttgagtgagtacaaacttgcttttgtcgttgtcggttgattttggtggaatatttgtgtgagatggccaattttttgtgtgtgtcagaaaaaactatccgtgctcaaaacatttcctgttgtgaggtggttgtattcatgtgtttattccaatttttttatttctagatctctgagttactttacctacatgtgtttcaagttttcgtaaacaattttaagaactcttaaacgtcttctcagaccaaatcagaagtgtgcattttgcttagactccaactatcactaatgggaaccagaaaaataacactttaagatttacatttaaaaccagttattggtttaaagtttcattctaaaattttagtttcctttcagaatttcagttatcatagttcttcagaagtatacttatgaattggcattaacagaggataataatctataaatagactgatgaaaatttggaagttttatggtacagtgtgtcttaagggaatattgtcaaaccagcagttttctaccttggcagtttgagacatcggttattaatacttttaattttgtagaatggtttcttatattaaagtatgtttgtcttatttgacattgtcattgatggttaaagttgggaggcatcccaaatgtctgttctatgtgtttattaatataataatacacttagcatcatatataataggggtgtcatgggttttatgtgtatggtgagaaaacatgaagatctccctgatgtgtttttaagatactgggtttcagttagggtgttatcaaaggacctggatggctttgtaaacaaaaacaaatgccataattttgtattcattacacagtttaacatttatggattttggttattttgcgtaaaatgtactttttattagattatcctaatattatacttacttagtttttaatatacttgtattaatttcttataatataacaaaagtattttttccattcacccacattttgttagcatagatgtttatcagatctctgctgagcaccgtatattgcttctaatcatacagatgccttaaatattaccagcttgctctgtaagaataggctagtgctggcattttcattatcaagtgaaagtgtttatataaattatttttacctgaatgaaaaattgttaactttataatgcagttaatcaaagtttattttagaaatgaagtcattaaacctagtattaaatttgagttttaaaattaaactaccagtttgtggcctaatgagccccaaaacatgccaacattggggaaaatagatcttgttttgagctgaaaatgctatccagacctacttaactttgacctcttaaatgagagccattttattttatttacagataaaatatgctgtagcattattataggactgtttaaaaagacagccaattaaatataaattttatggaatataagtattccataaaattttggagtaaagtaggtgacaattgtaacctgaagctctttcaatcttgagttgaatttattaagaaaaatcaaccccccctagtggcggctctcacattgaaaattatctttattagtaggaaatacattttaaatgtgttcaatttaatcccactgaagtatctccaacatagtagactctcaataaatatttcctttctttttggagtaatgaaggttgggaaattaaaggctctgaagcaactttacgtccaattcatgttcctaccttcaagaagaaaatatcaaagataactttcattatagaatctactataactttgcttagactgttgccccatacttagtgaccctactcagaaaaagagaacaaatcctgtgtttattttattctctttggaaatgaaagtgtttatttattttgtctcatgaagatagtcaaaaaggccattatataattaaatagaatgtttttccctagtgataattttgtatatatttttgtatttttaaggttttaatcataaagaaaaagttgtaatggatttcagcttacctgtacatagaaagttagcactgaatgttggcaaataataggtgttgagaaaaggggatctacactttaaaatgataccagctgtagtggtgattaagccattatgaagtgtcagaactggaagtcacttctgagccttagctgatctttctttaaaatgcatactgataaaaacttttacttttattaacatattaataatataaaagcattgtcttgctattctttttaaatgtcatgaatttcatatatgtaatactgaattgtattacttacataatactcattaaatgttttctataaatttatggtgccatttttaaaatagcatctaaaataaaagaatgggtcttttcatttacacaattatttctccatcatttttctttccaatagctttagatagcatatacatagtagttatggacacttgcttattagaactatgaaatgaagtaagtgaaagtgtttagttataggtaacattaaatggcaaaaagaggaaacaggtataaattgaaagcactggatctaaactaaaaaatgaggtctagtttcttcactgttacagatctgggcaagtttcttgaccaataaagcacgacagtcagcacctgtactgctactctcacaactaaaacagaacaaaaaaaaaatatatatatatatataaactgtgaagactgctaaagatacaaatgaaacagaaacgtaaattctattcttttagcttacattatcacagaacaatcaattcgcccgtgaaacagtaagaggcagtatacgattatgttctcaattacggctacggctgaaatgtgctacttcactggtgaataaatttacatagtacgtgcttactcatgtatttaattaagacagttacttagaaataaataccatacaaatcttttacaacagtacctttctacttttatgcttcttttaaaattgatattttgctagtggcttaatatgacaaaagatgactgtttattagcacttattctgatacaagcttgcccagttctttacatcattttcttcatttttataatagtactaaagaaaggtagtattatttaagtttatagatagggaactgagattcaaattcagagttgctcagataatgagaaagagtttggatattggatcccaggtctttttgcttcaaagcttgtgttcttactgacttgtgttcgtactgtccaggtgaacagattcagtgatgcatacagtacagccatatcctagggattttcactgtttcttctcagatagtgttatggctgaaataaattatttgtcatttcccatacataatttgtacttgctcatccccatacttgtgtttttacgtcctttcctcttagagtcttttctcctgtcttattgatttgctacccacctcccttcctctttaaaacattgtttttaaaggctgcataatactctgttgtactaatattctataatttttttaactgtttttcttttgggaggaaattttattcccaaccatttaatactttaatatttcagagaatacccttgggacgtgtaaattttaatgcaaatttatttttttaggaaaaaattcctgtaagggaattttgggatagaaaagtatgtgttgttttaaggttgaaccaaatcgtacactccaagagatagtatcaaattaagaaaaatttactaattacattccatcatcaatctggggatgtgactatatctttgcatttttgcttaaaaaatattattgtcaatttcataggcaaaagtgtggttggtaattaaagttatatgttgggatcatggttatgtataggagaagcacttgtatttgcagattttctacttagggtgtcctttacgtattcatttgttttgtcttacatttttcagtcatcttttagtttgttctttttacttctttctattgaaatattgttttaaaatgtattcctattaaataatactggcagattttaaaagtcaattatatatgtggcacatcttaagtatagcatgtgaggccttatcttttgatgtcttactgtggtagttagggattttagtgctgtcttgtctcactttaacctttttcaccttcctgcatcctcccaatatattttatcacaattttggattatatacacattagtgttgtattatttttgactgtatattgtttactgtttagctaagtaatatactgtgattatatttgccttcctgttctatgctattattgatttcttttctaccatcttcctgtttattagcatctgggtttagctgtcacttaggttcatcggagacagagtttgtgtttctggctcctgcttttcttgttttggtgtggttttctggaagagaagggtagttgcagaaagctagatattctgccgtcacagaaacagaagtgtcttgcctgtatttaagacccgatttagatgccacatctccatgaactcttttgcagcacctgtgttactgagcaatatattatgcttgattttgccatgttataaaatatatttcctcctagtaggaaaaagaatgtctttaaagataggactattatttgtctttgaaactaccagagcttcccagtacagtaccatgcacttagtacatatttgagatgtactaatttaacaattaactaccacttaaaatttttttggtaatgttttagtgattctggtaaggcagatacattttatgcgggttcgagggggaataaaaatgtgtgtttgcgtagaagaagggggaggggaaacaatgagttttccaggattatggaactagtagtggtttctaggccatatttcattttcctgatcttccctgctaatgtcttgtgctagaaactatgctgtttatatctcatcatctctcctcaggtatagcaaacaaaagggaaaggaaagaactcatcacaattatagggcagcagcaggagggtggcagaagacttctgactcattaaaagtggcttccagccagaattctcagaagtttttgtagatgtttttgactcatatagggaaataaaatatccagctgtgttcagcctgacaatgaagttggggtctatttgtgctatgtgtcacctccattacattaagcacatagtttatgattgtaaatatttgaaatttatattcagagataaatacggatgcactgaagctgggggaaggaaatgaagaatgaatggggttaagagttgggctttattgggtgtaggtagtatggtagggggattttattgaggaatacttcagatttcctagctgttagatggagagtagcaccatagtgctgagaagcgggtgcccaactccaggggaatgttgaatggaagggcacagggtcaggtacagggactggaaataaagataaacaagttatgggtaagtagaccaacgcagtaagagtagattaaatcaccccgaggaaaaatccgatagagcaaactcagtactgtgagaggcaatctcttgttaaaaaacgtcactttgatctcataggattactgaaaccatatctttgcatgtcattttgaggttttataatgaatattatataaaacagttatatttatgagtaaacttggttaattttttcagctttgcttcaaacactggctacaaatgatgaacctcatagacttttttgatggagatgttaaaaaggctttcaagatagcattcagactggcattgggcatactgttgggcctgttaccaccagcagttaaagcttgcagggcttctaaacagaagcatggcatgcagtcagctggagtcttgatttcataacaattttacagattgggacaagatttttgaggtaaaggtttcaaaaaataataagttactcctttgcctgaccaacatcatacggtctatttcaggagatgtttgaactccagagctcccaaatccaatcttacagggatgtttatttatatttcaaacaggcttttccttaaataatggttagcagtgtcctttcttaaagattcgaagacaatacaaaagtaaaaatattagcgtaatccaagtcaagtgcagttaatgtaagattactctatttttaattgttctgtatatcttcaagatgtatggatagatattaaatattttaacaaaatctgtacatttctcacaaaatcagtgaaaaagtgggtcaaatgcattacctttgttagctttaacaatctgacattttaaaagcttcaaatccagtacatctgaattgttaagttctgagggtacttcttagccctgaccttaattcctctgtgtatttgactttcttcctctgtgtatttgactttcttctatgacctccaaaatattctaccctggtttttttccgtctatcatttcttctctgtgtctatgcctcttccatagccctatacctaaatgttggtattactgaggtctatcctcaagccacttttttccttttctggtacagctctcattaggaaatgtagttgttcttctgagctacaaatcgcagaaccatttgcaacctctcctcactcaatggtttcctcttccttacttcctatagtgagttagtttagttcagtgaacatttgagtctggcttaaatctctcttcaagccagtcctttcttaacctcactgtcactgcctttggtcaggttgtgatcattccttttcttggcacttttggtcagcaaacattaattgagaatccactctattatgctgggcattaaggatacaaaaatgatttaagcttacatagaaataagggtgttaggcaaacaagtataagcaattatgttacttgacaatggaaatttgctctcatgttaaatattttgtaagacacatagtaatgcattagaaatgtagacaattttgcattatgaaaagcaagcctcagaatctagtgtgaggctgaatattgcaaagagccagcacaagacaggcagcagtaccacatggagggatacctttatgttactattagttctccctgtgtcatagcatgttgccttgtttcagcgtttgtgtcactctcttctctccagtgtttcataatcattactggaaagccaccaagagtgcaggactggattgtgtacacactttctatttctgtgaagttgtttgtatggaatattccttaatggaatcattatattagacatttgtataagaagtcaaatggggcagagttgctaatccattgtgaggtaggtcagggaggacttcatgaaagtgatctacttgagcggggacttgaaaccaatgggacataacaaggaggttgtatgaaagcactaaaccacatgttgtaactgtaagtaatttcttagctctggggtagaatagacaaaagcggcttcaatagaagaaatgaagccagaggggtaaatgaagctagaaagatcatgaaggattttgtgtgctaagctaaggaacatggacagttcagagctactgaaggagtttaatcagaggagtgacacagtcagatttatgttttagaaagaagttcctggcatcccggaatcctaacttcagcgaaccctgccctgctttctgtatactctatcaccagagtcagcttggtgaaacacaggctgatcttgtaaatctcagctcaacacttaagaacagatgcctaagtccgatttctatcgttactttgctgtctcctctatcttgaacatttttgcatcagacacccacatagctcacttcattttactcatgtctgtcctgaaacatcacatcagagagaccttcctaggctgtccaaaccagcatcacgtctgtcaccccttagtttcttaccttgctttatttttcttcttagcactcaccgccctaaaagttatatgtttatttgtttatttctccatcctccacctaggatgtaagctccatgacaacaggagcttttgtatattttgtttacctgtaagtgttctgtgctgggcacttgataggtgttcagcatttgttgaaagaatgtggccccaaccatccttcttcttttctctctttcaccctgtgcctctcccttcatgtgggggaattcttacagttcactaatccttagttatgcctcttcatgaaatcctgtccctcactcaagatccatctcagataccaccttttctgtaaaatcttttttcaagcagttgctgcttctgcttagctcccataacactttttgaatagttaggagaaaagtgtttacctgggctgtacaggatgtgatggatataaataaatacttgtcagcaagttattaattaaccagtagagaattacacaatgaggtagacaagcattataggtaaagtttgaaattcagttggttaagtggagaagtgaagtaattaggtgtgacttgaaatttgtttataaatgcaatatgattaggggaaaatagctaggggaaccatcaccaatttctattatatacacagttgtacagacaacctggagaaggtatctgttgatacatacataaacacacacacacacacacacacacacacacatcattttaccgatgtattaccttttttgtagaagtatttacttttcatcttctttctgcctaaagtattacttctccacatacatcactgaaaagaaattatctagaaatgttttgattgggtcatattaatagcactatgcccaggccaatttctactttacaaaagctgatataattccatttgaattgtcaaaaatgtctttgttgtaagaaaacgctagataattactcttctggctaacaggaaggtatagaggtataaggtataaattactttagtttcccagttcagcgtgggtatctgatgatttttaaattcactttaagtgattaatgtctgctgtgaaatcctggctggggtctttgtgtgaagttattcaacttttcttttctgaactcatgttcctctttgacccataagtgtctttattctcaggtgaaaatcatgctaaattgtttagggttccgttgaactttctaattgagacacaagctacgaaagctaataattaagtataattattgtctacatgtaaaagcaaaagttgctggtaatcaccattaacctctaatatttgccaacaagaaatgtaaatagcaaaagtcaaatttattcttcttttaatatttgaggaccacattagatggctggaggaccatctgcaggtgtcagaggggctttgggacattatctctaatgagttgaaagtaaataaatacagaaagctggtgatatgaagataaatactttatttagggttgtccttgtttattgacaacgtcaatgatgctgagatgcttcctgtggaagatagcaaaggaagtatgattttcatataatttatcacaaatttctctttttaattttccaccaaacaatggctaatgcatttgagaggggaaaaaaatcccagtagatctgttaattgggaatcactgtgctacaaatgcttgaagtataagcaaacattttcctatgatgagttcataagctttttaatgaaatattcggaagaatttaacccattccctgtttttcttaagatgtgaaaggaagattttagaaagacttacgtaaactttaagtagactttaaaagtttgttgtgttagagaaatatttgaggagatgttataatgcaatagaaatttttgctttatattttttaaaggattttttatggtattttgtttgtttttcagagtaaagccaatcccagctgaaggaatcaagtcaaatccttccaagcggcatagagaccgacttaatacagagttggaccgtttggctagcctgctgcctttcccacaagatgttattaataagttggacaaactttcagttcttaggctcagcgtcagttacctgagagccaagagcttctttgatggtaagacagaagggtttaatttgtctacaataacgtataaaaaatacttgtactagatatagctgtttctgtgttaataactacaaaaattagccgtatttggaaaatttattgctgtatagtaaaatttcagtggcaaagccagatttataagtcttaaaatcaattttccagttttattcacccaacagatgcagccactgaaatgatgcatggtatcattctttgaaaatcatatatttagaagttacactcaaattgattatgtcaaattccagtttcccttctacttcaatatttaaaagtcttttttaaaaaaaaagaaaagataaaacaccatcttgctggattttctgtgttttcatagacatgtcattttatttatccctccaaacttacgtatatttctaatctttttttttttttttgaggcagacttttgctcttgttgcccaggctcgagtgcaatgacacgatcttggctcactgcaacctctgactcccgggttcaagcgattctcctgcttcagcctcccaagtagctgggattataggcgcccaccaccacgcccagctaattttttgtatttttattagagatggggtttcactatattggccaggctgctctcaaactcctgacctcaggtgatctgcccgtctcagcctcccaaagtgctgggattacaggcatgagccactgcgcctggcctatttctaatattttacattaattgtataccgactgcaagaaatataattaaaacatgtttttcactagaaagaacatttgattgtaagagtcaatagaatttgatttcattctctattgtgtcactgaaaactgtttgtcattaaccaaaccaggtagcatccccgtatctcagttttctcagcagtaaaggttggggttttgagctaggcagctggatgatatttgttacctttaaattgcaatggaagtttttgtttgcaaatgatgtttcagtgtattttctcatgtaaaattaatttttgatttatcttttatctgtctataaggcagaaatagattttttaaggaaatggtctttttaaaatatcatataattttactaaccatagcaagttaatgataaaatctcagtgggctatgtcagtcaatgcttctcatacattaatgtgcttacaaatcacatagggatcttgttaagatgcagattcttgttcagtagctttaggtgtgtccctagattttgcatgtctaacaagctccgagatgatgctgatcctgctggtctaggtcactaggaagtgcctagacaacacgtttatggatatttgactggtaatttgtgtttagaatattgcaacagttaatttccctttagatttatgtttacataatctgatgtgtttcgtctgagcatctttttattgatttgcttgcttgctctcccgtctttcttttggacaaaagctatttagtttaacagttgtggtctgggcaatatacagatttgaggatagtgatttcaggaaagattatatatttcaaagtttcatagtacacaaattttctctgacctatataaaaagtgtttgaattttcagttgcctctataccaaacccttcatcttgggagaagagttacgcagtattcagtgatggtctgtaagtatgtgtgtattagctatagtcatttagctgacatagttggaactagaactcaggtttctagattccttatattgtttttcctgaccaaataatacctacttttttctgggaaccttcgcataggaaagcactgaggattttttcctagacctgtggttcttaaaagtgtagtatccagacaggcagcatcagcatcacctgggaacttgctagaaatgcaaattattgggtccaaccctagacctgtggaatctaaggtggtgggacctttggtgatagggctagatgcatattgaagtttaggagccactgctgtagattgtaacttcaggcctcctcccagcgtcacggaatgctgtcctgatccctagcatttactcacatgctgtgcttagtgcttgaccatgtggtggcagattctgtgatgtgtaagacgtggttgccacccttagagattctggagtctagaagccaaggaggcattattctctgactctgataaagctttattgacttgagtcattttacctttccatttcttgttcctttgtaatggggaatcaaattatatatgttaaaaagaaaaaaaaagtataggtttttcctctgtttagaagtagtacatatgtgtgtatctagacagatacatataaatgtgtgtgaaacacacatatataaacagatatatttctatatttaatgtctacattatgtgtgtatgtgtgttcatgtatgtatacacacagacacatacatgattagataagtgtcctattattcagtgcttcaagtaaaggagatctcacagtctatcttataaagcatgtcatagtttaacacagggttcatcacggaattgttaaaaacttttttctcagctcttcattaatgagtttgtctgttttttattctggttcagtgtatttgacagtaggatcttattacctatttgcatgattccttcatcaactacattatcattatctttaacgttagattcttttcaaactgcattgtgcataagaattacctagaaagctttttaaaatgcaaatttggaggcatgcccctgctgataacaaggaagttctgtgtaaaacccaagaatcagtattttaacaagcatgttacggagtctgaggcagtgatttagcctagccttgattatgccctgaacaagttaatttttgtttctttgccttcagaatgacaaatgcaaacatacaaaatttaaagaagtctatgaatatttttgcttgtgttatagtggtgtacattcagcctaagcagtttcttagattgtttgatacagaaacatacagttagatggaaaatgaaaataataaggttttttttttaatccccaaatttcctccagactaccagtggtctggaaaggcaatgcaacatttcagagcacacagagaatgaaattataagggtgacccttatgaactgaaaaaatggtagatgcaaacgaagagatttgaaacatgctaacaatgattaggatttttgtgtgcagttggacccactcttccactattagggaaacagtatagcgaagcgaagggaagctcaaagtgaataacaggatgcaaacagggggtgtgtaaattcctgcggaaagaacaatataaacgagtaatcatacaatcttgttagaaaggaaactcaagttttactgtaacaatagatatttttccaagaaaatacatctatttattgcaagtttaaataatccaacttggatggatcttcttaaagtttggaaccatgactatactgctgctgctgtctgaaaagcaacactataaagttttaagtactacattaatatttatccatttctaattaattaaaacatattgaaatataactttaaaatacttgaacaaggcttagcaatttttcagttataaagtcgaaaatagtttctttgacatgatttaagcattacatttaaatatattatctctgagatggagggtattttaaaaatttaaataacaatggttacaatcaataatagtttattaatagagactaggatttgggtggttacaatctaatctttgaaactggttgatgtgaagagaaaggattgtttcctcctatatcatgtctctcaaaattgttaaacagtgtacactgggcttgttgatcaatctaatcagcattgtaatgtttcattcctaatttcagcatatctttaatacaatttttaatgagatttccttactattttttgaaatgcccattattatgtaaatattttgttcaaattattctgtttttatacagctgccccaaaattgagaattcgggaatgactacttttgttttctgtttacatacaaacacctaatgagcctgacaaaatggagcttagggatccgagtttctgatttcaaagtcttgcatttgcagctgtcatagggaatagtagtattctagttatttttaaaacaaggtaatgttagggaaaatctaagtcttgaatcattatacatgcttaaaataatcaccattttataaaatgtagaattatttacatgttaaaatattttcattcattaagcctaaaaatgctgtgggaagagaggataatagttatattatgtgatgatctaacatttatttgaccccattgtttatcatggatctttcttgactttattttaaattaaaaattacaagtgctctgttcttggtcttccttttgcagatgctttaacagttcattcccagttcattaggttttccaaagagagctattgtgtttattcatcttcagcttgtgcatttctctgaatttcagttgttttggtatctctctagatcagaacattattcttgaaaaacaagtatacgtacatgtgtatatgcaaagaacaagcttgaacaagcagtaaaaatgaagtaatgcacttctaagtgttgatgttttataaaatctaatagatttgtatgtctgctttttcattcatgagaattctataatttcatctgctttgttgtaattttaaaatttctgtgtgtcaagtaatttaccaaagtttcagtatgatagtatcatagcaaatgttatttcttaattctaggactatccaaagtaggtttgtttgcataacagtttagcacatttgaaatcaccaaataaagtatttgttgaatttgatttacccatggcattatccatcttaaatggtgatttaactgttatcttttttcctaattcacattttaaaacatgaaactctaattacaatattcatgataactttcatagctaaaactatataaacctaggttcttttaaaattttaatttatggaacccctgcagatttaaacatgaataaatacaaagaatagtagcgcattcttattgaatgaatatacaaatcctggctctcatatttaatattgtgacctctttggttcaggaatttaatctctcttttcctcagatatcccaatttacagtataagatttattagattatatgaataaattaatatgatagaactttatataggatacttttatctctgcttttgtttgctttgacaactattttgaagaacacagtgacaaatatctgagattcaaacaatctaaactcattgtatcatatattatgtattttgctgctttcctgtctcttttaaatttactgatttaatggatttctctttgatcattacctagtcttgcatggttctagaatccttgcttatttggccatgaacaggtcattagtcatcattttttttctttttagggagactaccgtgggctaacattaaaatcaccaactttcagcaattttccttttttagaaaattttcaaatacagacatttaaaaatctgtagttaagtcttaagatatttcgtgagggtttgtgatctggttaatggaaatgtacaccttcatgttatagtgttttataaaacatattcatatataatattaattatattaaaatctgaagaaatttttatttggtaatatttgtatattatttttaaatcttgctcttacagccttttgacttttcaatcaatgaattttaatgagtaactcaaattcgtttatttgcttatggctggagatttagattttagagtcattttatcgtcagaataacattttaagccattaaagtgaataaaatattccagggggagaacatgtagaataagaggaaaagtaccaaagataagatgttttaaggatgagcaggggtagtaaaaagtgaaatctgtggagtatgaaagtatgctaaggtgatagagttgacttaagatactttcatttgatgtgttcttaaattggagagccagagagaaaactgtacatgaaagtgaaaactgaaatgaaatgaaagtgtaaactgaaatgaaatgaaagtgtaaactgaaatgcaatgaaagtgtgtacagaaaaataataacactagagaaggtgatttctgttccttgtttgtccatagaggccaaaaagccattcagttgttagcagtgggagattaagagggagacaaatgtctgggctctgtggctcatgcctgtaatcccagcattttgagaagccaaagcaggaggactgcttgaaagcaggagttcgagaccagccaggacaacgtagtgagacctcgtctccatacaaaataaaaaattagctgggcttggtggtgtacttctgtatcccagttattcgtgacactgaggtgggaagatatcttgagcccaggatgtcaaggctgcattgagccatgatcgtgccactgaacttcaggagtgagactgtttcacacacacacaaaagacggagacaagtagtctgatgggattggttgacataaagaaccttaatgaattgtacctactgaattcttcatgtattttctagcctgaaattttctcatacaattgtcatatttacagagcattctgttgtcagctggatttttttttatcgtgtctaatttctgtgttatggagacatttcatctctttatctcagcatggtagagggaggttgtgttttgtgattaaagcactgacagcaggagctgtggatgctagttcagttaacgaatcttgtgttttttgatagactttaacctcactgttccacagggtcttcatcttctcagcatgtttgataaagatgcttgcttgccctgatatattaggtttgtagtaaattctaaaaatgagagatctgtgaaaaatttttataattaaaattgttactgttatggaaatcatagttatttcctgcagaatcctgatatttcacttgttttagtggagaattttgtttttttttttttttttgaatatgcataagggcctttacggacctggtattaatatcaattgagaatccctttgtttaattaatttcatattttttatttagagatggaaatttgttaataaactgtttttccccttttgatataatacataataatttacttacatatactgttttcttttatcgaaagtggcacatattccaaatctggacacttggaaaagtgtgatagcttgctttggtgaggatagaaattttgggcattgtatgctacttgctttattgggatacatgtcaaattttctgttattgcgctatgtcttaagataggtgcttcagcttttgtgtttgtaaaattgttattatttcccgaagaagttcacaataataactgtgctgaacagcatggaatgataattttaagaagtatgagggaattcaatccagaacatacgtgagttatttcctaaatcctgaggttctaagtctctgtttctcaaagaatggcacctcattctcagcatcactggggaacttgttacctatgcaaactgtaaagccctatcctagacctactgaatcagaaattctagaggtgtggctaagcattgtattttaagccttccaggtgattctaatgtctgtgaaagcttaaggatcactgccctcattgagtatttacattatgttacttaaaatgcaatttaaatactactcttgtatatatgaaaagctaagtgcaactcattccccactgaaaaggtcaattaactgctcttgttccattaatgcagagatttgtcatatagttatagaggaattgtataaaactgagtgcgtaccaatgagtaactggaagaatgttaaacatctttggaagtcagtttttatgtaagagtttggatagaacaaacttttaaggactaccctgccaaagtagtaaaggggatggtaaatattatgaaattaattgaatttatagcagcagttagggactaaaaggggatatgctttccctggcaagatcatctttctgtttaaatgcaaactatagtaacaaaatacaaaatatagtttaccactattcggtattcctcatgaatttttttttccttgaccaattcaaagcatgtgatatgaagagatgtggcatttagggagtaggggaaatctgagcttagatgtctaaggaaggaaagtaccgtattaggaaacatggatatggttaaatgcatgtgggaataaaacttgagtcatctgtggtatgaccatttgataatgctgtgatgtatttgcactctaaattccatcatttgttagattaaattcttatttgtattgtacgactccttcatagatctttcaatgaggaaatagtggaaatattttggtggtttactatcttaacattctactgaatgttcagagtctgattctcacactttggaaagtggtacatatcctcactgatggggaagattttaacaaatgcccattacggtacagcagatacttcccagctggtgacctattttcagatactacattttgtttctgtggactgtcataaatttaattccagtggtgtaatatttaaagtgtcgttatgcatataatttatgtaacaatttacagttttgaagtatagttgacccttgaacaatgcattaataacatgaacagccgattaatgtgtcttttgtatatgtattatatactgtattcttaaagtaggccagagaaaagaaaatgttattaagaaaatcataaggaagagaaaatatatttactgttcattaagtggagtggatcatcatacaggtcttcatcctcattgtcttcatgttgagtaggctgaggaagggttggtcttgctggcttgggagtggcagaggcatgtaagtggacttgcatagttcaaacccatgttgttcaagggtcagctgtactttcaaatgtgtcatatagttaccatagtaatcctattagatactaattactgctttccacttaaagatgataaaaatactcagttacctccttaggggcactttaattgtaagtttctcatcatggtttgagggtgtataaagtcagcatagacttcgttacctctgtccttgattgtcagtgattgattccaggcattaccctggtattgtacatgttattttaatcctcacaagaatttgtctcaagaggtagcattgtcctcatttaaagatgaggaaactaaaggtcaaaggtagttagcaaagtgggcggtggctaataatagctcacacactgaggtctggctacctgagtttttgtctaagctctgccacttaaatctctatgactctgaacattttctcaatctccttaagtctcacctttctaatatattgaaataacagtgtcagtctcatagaactattatgaagattaaataggatataatacgtggaaagtgctaggtgtacagtgtgtgcccaatatcacatatgagtactaagtaaggtcactccaatggtaggaagcagctcttgtgacagtgtctcatgtcactttcttactcattgttttctttctaatcagcacaagcaatatatacatgaaaatgagtagtattgatagagcctctagtaatttactaagttagaggtagtaggcatgagagcaagaaatagaagaaaaacttcatgcaggggtagacattacatagtttaggctgaaaggccatgacataaaatgtttcctgaaaaagcacagcagtgtttttttaaatgattttaaaagtccacccttctcagactcatctttgcacaatatttacttcaattatttaccagtgattaaccttaaacacaagagcaacagaaatatttgcatatttgtttttggtagaaacctccagtgatcattccgccaaatgaacttgtcacttttcctacttatgtagtagttacacatattatctatcatccttccaacatttggaattataagcattgttgtttagaaagaatttgttctttttattttttctctacttcaagttcctgtaatactttaattaaaccctattctggtacttagtatttttgacattgttttctagttatttccatagcttatatcccctacttaaagacagggtctgactcaagtgtctaattacattggctaatactcccagtacaagcccaagaacaaattataaattactctaagatgaatggtctctttcattgcttagtcatcttctcagtgatcaagtagttatctcttaatatttatgtttttctactgccagtgactctaggtggaactaatatcaattgtgttgattaaatattaattttaagagattccaaacaataatttagatatataaagtctgacactgttattgtccgtttttaggcttatttcataatgtaagggtttggctttgttgttttctttttaaaagcaagtgttactgatgcttcataccagagcttttagaaaagtaacagaatatagttgactctgacgttgtatggttttagtgcattcaagcaaatgtggccattagtaagcaagcaacaacataacttaccgaatagaaagggagaaaaggccattctctcttctgccattctctctgtgtacagattaaacatttcctttggtcttgatgaactgttaggtcagtttacctcaaactgttttttggcctaaggaaatctgttctctggccttttgaagttacattcagagaccgtgcttttggctgtttcttgcaaagagatatgttttaacttctgcaaaggccagaatggcatgagattctggtgtgacacattcactgatgatttaccagaaaatacactgcaaatatgaaagactgcagacaggttttatatgtggaactctgctcagactgagagaaagtctagttattagtaaatctctagttttttcagagctggattattttgtcacataaaaatatagtgagataaatgttaagaggactgccagagtcagttttatttaatggtttctcttattcaaatatcacaggttaaaagaaggtcagaaagtggcaagtatctaaaagattatgctttataaccaagcaatccataagctctgagaaatatttctactaattacagctactgtttgttgaacagtattgatccactatgtgtcagaaactttacatatattctcattactcttcacaacagccctgcaagatgtgctttaaaatttttttttttaattaccacctcacatattaggagacaggctcaaataactcccacttttagtaaatgtcagaggtaaggtttgagcccaattctgtcagttaccaatatccacatgcttttaagtgagataatatttgaaagtgcttggcaaaatgtttaagtggtagctgttattatttctattcagctgcgcttcctcccagactataaatacatacataccacacacatacacacacacacacacacacacacagtgaggaaaaaaaagaagagatagcattataacatgacacctccaatagtaagcatcctatcatgccatcagactttccttcacatatataatccacaagcagttaaaagctataccggaaaagccactttacaagatgtaatacctaggagtaaatataaagatacctgtgcacatcttttttgtagacaactttaaaacattctagcaggacaaaatatagacttgaacaaatggaaagaaatgtatgttcttggatagaatgattcaagattataaagacattaattctccatgagttaatttataaatttaacatgaacctattaaatagtcacagtaattaacagtttttacccaaatgctggacaagaagattccaaacatcagaaatccatctctcaataaggtgtatagttgctttttttctcctcaccaccaccagttccctaatatttcaataaatacataaaaatgttggattcatttttataggttacattatggagaactttagtctcctaagaaaggaggtaggagtggagaggagtgtttgtaacagtgttgtgcagttctttgaaactcctaagttttgtgacaaaattatatcgtgaactcatcaaaaattatttttaacaatctgtcagctgacaacttgactaaacccttcagttttgttactagcatagaataaggagctacccactggcaacaggattacttacctagtatttattatttaccttgttttagccaaatactaaaaataccagtggatgccagtatttcaaattgtctttgtttggtgttcagaagttttctattatagctctttactcttgcttacttttaaaatcattgtttttcctttttttccatagttgcattaaaatcctcccctactgaaagaaacggaggccaggataactgtagagcagcaaatttcagagaaggcctgaacttacaagaaggagaattcttattacaggtaaattttagtaaatatagtttcttacactaaggacagttgtaaatggaaaatgaattaataagtcttttagtaattccctgtttacttaggatttgctcaatgttttttgccactttcatctgaactgcgatagtgaatgatgcttaatacatgaaaaactggaattatagtcatgcaccatataatgatgtttcagttaacaacagaccacatatgcgacagtggtcccgtaagattataccatattttttactgtaatttttctagtttagatacaaaaatgcttaccatgtgttaaaattgcctacagtattcagtatagtaacatgctgtacaggtctgtagccttggagcaataagttatactgtatagcgtaagtgtatggtagactataccatctaggtttgtgtaagtacactctatgatgtttgcatgatgatgaaaatcacctaaccacatatttctttgaatgtgtccctgttaagtaatgcatgactgtatatgaagtagattagttagaagaccggtcaaccccttctgttgtattaatatttcttcaaacagcaagaactcctagagtattttagaggttctaatttaagatgttgaatttatatatatttttatggaatgtatctctattaaaattgttaaatgcatttcttaaatagtttaaaatagttcttaacccaaatttcattttgccaatatgttataacttacattttattttagcaactgtttgtgacttattaacatactaaagattttctcaacaactccaatccctatttttatgcttcagaatttagtttctaatttgtctatgaaagcattttgcatctttttttactcttttttttagaattgatgccatgattgattctcacttaaaattctcagatacttattttgttgaaaaaagatagaataaagatgtgtgccatgtgtgctgtcaccgctatgtgatcattatcagtttcacccactgaactgactagaaaaacttcaccattgttacaaaaagtaaccctaagtttcggtaactccactagttcattcagtggatggtgatgtgcctaataatataacatttttattacaattgtgtaatcacattcaaagtcctgttagcaaaaattaacttatgttaaacaaagtaaatctattaaagcatgagtcctcccctagccccaactgaggatcttcatgtatatgtaaacccaaacataaagactccttattcaggtcataggaaagcattttaataattgctatttaagatgattaaacacacctcttgggttttctactaagggcctaatgaaatcccgtatttcaggtgaaatagacagatatgtactgattgacgtaacacttggcaagttggtttaaattatgggccatttttatttttttcccaaaacatttaggcaaattgtgtacataccctatgtcagggaaacagaataacaataatatgaatgcaaagctgtaaagctataattatatggaatatatatattttaaattatctgcaaattggtaacccttaagaagttaaaataaacttacctgtttatattgaataccatttgtagattgctcttttaataggaagactcacattctctatgattttcttaggattgtgcttatatgttatctttttatgaagaagatgactaaaaacattatagatatgtggaaatggctgtttgattataacaattgcataatgacatctgactttatattgcaaccgacggttatcagccaattaccactacagtgtgaaaggtgttaccagaggttctgtataccatatggcctaaaacttttgaggagaaatattttcctttgcttaacaaaggcatatgaagaaaatgttacaaaaatttttattaaaggccaggtgcggtggctcacgcctgtgatcccagcactttgggaggccaaggcgggcagatcacgaggtcaggagttcaagaccagcctggccaacatagggaaaccccatctctactaaaaatacaaaaaattagctgggtgtggtggcgggtgcctgtaatcctagatacccaggaggctgaggcccgagaatcgcttgaagccaggaggcagtagttgcagtgagcagagatcacaccactgcactccagcccgggtgacaatgcgagactccatctgaaaaaaaaaaaaaatttattaaaagtttaagacatctttctaggttagcttcaatttattactattttacaaggaataaaaatgaaacaatgtgaataactgtgtctttatttacttcacatgtttatttcataagtttaaaatatatctcttgctatttaatactgtattgttaaaatcttgcagctttgtttttcagtgacaggagttgaaattttatataacagtattgcagtttctctgaaataataagtgagcttaacaaaattttcagataggttgagtgaatctttgtgactaaaagaatgatgatctcttttatttaattagcatattaattccttctgttaatttattgagagaaatcaatacaagtaataaccttgggtctcctggtacttgagatcatttgagatatataaaaattgatgtgcatctatcgtttctagatttttatttctgataataacatttgtctaaagagatttgataactgtacttaaattatccttctgtcttctggcatgtacaccaatgagtttattggaatgtgactaaatttgtttcactgtttgaaaaagtatgatgttctacaaaataatatgaatgtgatcaatggataatcttccctagaagcagatattttcaggatgaatcagtgcaatgacggatatatagtgttactgccaagagaatttaagaatatccaattttgaatgtgttagtcattaactattcaagttcttatgggtagaatcaccattgtttatcctaagagaattgccaggtattacatatcatatttgcagtcaaaaacctgagagcctgcttgtggttaaagggacatggatggagccggaggccattatccttagcaagctaccacaggaacagaaaaaccaaataccacatgttctcccttataagtgagagctaaatgatgagaacacatggacacacagaggggaacaacacacactggggccgtttagaggctgcagggtgggaggagggagagaggatcaggaaaaataactgataagtactaggcttaatacctgggtgatgaaataatctgtacaacaaaccctcatgacacaagtttacctatgtaacaaacctgcacttgtaccactgaacttaaaagtaaaaaaatagaacaaaacagtcagaaccatgcaccaatttgggatcgataacacataaaggcagcatatcatgttatttaagtgagtacgctttggagccagactgaatttatctcctggatcagccattttctggctatgtgaccttgggcaagttacttttaaaggtatagtccttgacctcagtttcttctattgtaaaactggaacatggcacttacctcattgggtttttgggagaagaaaccactcaaatacataaaaacatttagaaaaaggaatactaaataatagttgttatctttgtagtcaagttcttagaagtataatatagatcaagaatcttgaaggtggaaagtaattggagtggaaagagagacagtcactgtatttcatttatttcatctgataatgaagatatcgactggactatatgtgagcagcataagcactagggcaaagacttgttaactcttaaatcccagtacttagcatacatatctcctcttgggtatgtaatagtttattacgtgttgaataaatgaatcactattatttatatagctctttatagttctcaaagcatggtgatataaatctttatttgctcatttctacaaccatataacattgtaccttattacactgagtgctggctctgtgccaagcattgagttaggtgggatatcgtcattatatctacctgatgaagtgccagtttttgaaataacactgaagcctaaaaagcagtaaatagcttaaccaaagccacacagctagtaatagacagagacaggagtccagaccaaatctgtctgactacacagtacaattcttaaactaaaccatactgtgtttctccttacatgaaaaacagggtgttagaagacattagctgtgatcacatagtaaagaatagatcaagtaccaaattgaactcaaggagaaaatagtgagggcttgtagaattaaaatatatgataataataaagtgatctatgatactattgttatccaagaggagaataaaggtattagttgatattggacttgaattatccagtaataggaaaagaaactataacatccaaactaaagagtatgggctaataaaaaataatggacccaaagtaggcaaaacagagagaaaaagaaacattatacatgtgaatgtgctgtgaacaaatagaaataacacatataaaatgataaatttaggtatgtgttcataatgacattaaattttagtggactaaattcactgtatgcttgctttacatgtgtattatagtttaattacatgtatattttatatatatagtgttttcctgtaaaagtcttaaaatgttctgtgacttaaaatgttagcatcagtgcttgaaatgtctttgtacaagaagagttttctattaatgttcccagtttaagaatctaatcaacatctttgcctcctgtttccctctaaaaaaaagcagtgtgatagactatagtgaatgatgtctagtttgttttttaaaaaatatatacaatatatttaaaagagaaaatctgaaacatgaagaagatgaattccatattctaccaaagttattctgattgagcattaaatttagccatttttccatagacaaatcaaaaggtatgaatagatatttcttagtccaggagtgtatgttttggctgtgtttgtgaaatgtgacaattttaactattttgaagagaagaattttcagagataaaagtaataacctttatctgatggtcaatattaagtcatattactaattttagaacttcctttccttgtaggctctgaatggctttgtattagttgtcactacagatgctttggtcttttatgcttcttctactatacaagattatctagggtttcagcaggtaagtatatattatttatatcatttatattattatatcatttactttttatatatatttaggacacagttggccatttgtatgtataaagtatcaatatatgctgtagaatacagtatgtatttgtagctaataattttttctaatattaataatttactgcactataattcctttaaacctttatgtgattcatggttactgtgtttcttctttcgcttatcaagaatcttatatataagaaactttcaggcacgtagggtctaggggagaagatacaaaattatttgctatcaaataacttatggatagcagaggatatatgacaactatgaaatgaatgagatgctgttaaaaagtacaagtaaaatcctatgatttatacctttaattctgatttatttggattatggaagttaccctaaatcaaatggtatgtaagctgacctaaataatgtgtaacaggtgggtggtcaagaaaacataggaatattgaagtactgtaagcattagactggaagtcattgaaggaaacagacgtgtctgacttgtttgatgttattgaatgaacagtgaatagatggaattataaatatttgatatattggaagggcaagaacatcttttatggtttgagaacagattgtaacatttgaatgcttgctattctcatatatctggttctcaaattgtactgtgcacaagaatcacctgaagaccttgataaaacttggtcatccctgtgagccccattgtcagatattctgaatcagtagttcacagtggggcccatgaatttgcatttctattaagctcacaaggctgctggtcttaataacagttatatagactagagcttcaactatattatatacccagtggaaaccactgaagggttttgttacagggggtgtgtatatttcaacttgtgtttcagatgcaacttttggaaattgtgtaatggttggcatcaagatgatttaatactagaagattaggttcctaggaagatttaagtgtagatgactaaagtagtggtatctagctactactgctaccacaaagtctaaactcctgatttcttgcattctaaagaaaatacattaatgtccatagaaaagcctgtttgaagcctaatgtattatataactgtcttaatcaggatttgatattgtgatttatattagtaagaaaatcagagagattagccattttccaatccatttttttctcgcatatacacatggatttttttcctaaaagaatattcatatctgacgcaagtggtagattaagacaccatttttaaaactgcaagttatgactcgctcatgggtatgcagtcgagacagtggatcactatcaaactgttttttagttgtttaggatagaataaaataatatagaatacacagtgttatctcatgtaataatggtaagtgttttgtgaaacttttccatgtgtttatgtctgtgcacacacctgtgacagatggaaatgtattttttatcataacttgcagttaaaaaaaaaggaaaactctggtttaagcactaaggactcagcaccgtagtaaatggtgagaggcaagagaaggaaagtgggtttaatatggtaaaggcacaatcccttgctcttgtggagtctacttggagtgaaaattttatatgaagaaaattttagagaacagtgaaggaaatacataaagaataccattaagcttagagaagtcaaagaggcctggggtggttaggaaaagctgcatggaagagataagaatctaaaaactaacaaatgaatatggaacataaacagattttaatatgttgcatttaaggaatggggatgtgacttatttgagcaagagcattcatgttgggaactgatgacaagtaacttttggcttatctgttgtagtgccagtctctttagctttttctaccttaggttctatcttaggtgactagggaattttaggaatcattcaattcgtattcatcaccactagcaagcacccactaatctaaataggctttaaaattaatttagccatattttttaatcagtccttttgttgtattccttgtatcttttttctttagtctgatgtcatacatcagagtgtatatgaacttatccataccgaagaccgagctgaatttcagcgtcagctacactgggcattaaatccttctcagtgtacagagtctggacaaggaattgaaggtaagaattgatggtacaaaaaatagtgttggtagtttttaaatatgagtctgtgaaaggaggctgggaacctgtagggtcatagaactccatgatagggaagtagtggaaagatgtaaagtctgcaatcataggccacagctaggtcacaaagagcctgatgagctaaggaatattttggcaaatgagagccatttaatgagtttcaggcaacagagtattgccatagtcagtaatgtattttataaaaataagtagtaccttcatgaaagatggaaggaaggtacaaggttgatacctgagtgcatgtaaattattgtgtttaaaatgcaccaaagaaaaaagtaagctagcatatgcaagtataaaaatgcttttctcaatgcaaaaaatgtttttggaaatttgttaaagtgttaagaaaacaaaaatgcattagaaaatatgaaaattgttgacagtgatagctcaataaaaatttaaaaaattatgcaagttctatctgataaaagtgatatttaataaacttttagtttcttgtcattagctcttttgaaaatgatttttttgtattcagaacacagactccagtttagaaactaatacaaattttacctattcaagtgcttaattttacagcaaaatggaaagtaaattttgttttgcctttatttctacagaagccactggtctcccccagacagtagtctgttataacccagaccagattcctccagaaaactctcctttaatggagaggtgcttcatatgtcgtctaaggtgtctgctggataattcatctggttttctggtaaggtacaaaattttatgatactggcttttactattgttacaataaaagcttgaggcaaatttaatttagcaaaatataattcagcagagaactattcccaaatcaggcaaccctcagaaccagagagcttcagagagctcacttaaaaacatgggctggagcatttatgaacagaaaatgcaagtgaggtacagaaatggcttgattgattacagcttgggatttgccttatttgaagatgatctgattagttggccacctgtgactgactgagactcagctatttggttacaaaagtttaattctactgttaggctttccgttagcttatatagtaaatgaagttgcaattccttggtaaggacttaaggagcagaggcatcttcagcccaaatttagtttaacattaagttatagaaaaaacaagccaattttctttggttatctttgatttcagctttaaaaatctgctaccaaataatttgataaaggaaagtaacattttaaagtaattatttctgattttgactatcttctataactcagaaaactgttctttaggatatagtaacaaaaattgagtgaaataacacgaagccttgtattttgactattttaggatttttaaggtatgagagaattatgtagcccttttttaataggaggatgcttaccatcttgggattgaatgcctgctagacagagaaattatggcctttccatatgtctcaaataactgccacatagaaaaacgattgtatattcatgattgtggaatcatcatttgataggagatgctgttttcttgttacaaagtctgaacacctgcataggagttgactgtagggaacagcttaggattcctcagagtggacttgtctgttatctcattgtatccttagctcatgttaccaagtacaggagaagaaaatacaaagtatattgtatattctttttgtgaataacaaggaatttgaaacagataatcaaatcttaaattaacattaccaagcaatgatttttgtttatgtgtttatttctgaagaggattttgctgacccagaattagaattatgctttgagacagttttcccagtgttattgctcatgaacaattagtatgtagagtcatgtcctgcataatgatgctttggtcaataacagaccatgtatatgatggtagtcccatgagatcataatggagccgaaaaatccctatcacttaatgatgtcatagcattgctcacatgttgatggtgatgctgatggaagcaaacctgtgttgccagtcatataaaaagtatagcacatacaattatatatgatacataatacttgaaaataaaacaataataaatcactatgtatttactattaatcattattttactttatttttaaatgtattatacttttaattattttattttaatcattattttagaataaggttaactgtaaaacaggctcaggcaggtccttcaggaaatattccaaaagaaggcattgttatcacaggagatgacagctccatgcatgttattgcccccgcagaccttccagtgggacaagatgtagaggtggaagataggatcattaatgatcctcaccctgtacagacctaagctaatgtgtgggtttgtgtcttagtttttaacaaaaaaagtttaaaaagtaaaaaaattaaaaattaaaaaatagaagaaagcttatagaataaggatataaagaaagaaaatgtttttgtatggctgtacactgtgtttaagtgttattacagaagagtcaaaagttaaaaatgcaaaagtttatgaagtaaaaatgttacagtaaactgtgctgggattacaggcataagccactgcacctggccaaaaggaaaatattttttataaattcagcgtagcctaagtgtatagtgtttataaactctatagtagtgtacggtaatgtctcaggccttcacattcactcaccactcactcactgactaaaccaaagcaactttcagtcctgcctaccttgtttacaataagtgctcttatacaggtataccattttttgtcttttatactgtatttttactgtatattttctatgtttagatacacaaatacttaccatcatgttacaattgctttaagtattcagtacgatagcatgctgtacaggtttgtagcctaggaacaaaaggctatactgtatagcttagatgcgtagtaagctataccatctaggtttgtgaacctaccctctgatgttcacaggataatgaaattgcctaaggacacatttcacagaacatgccccttttgttaaatgacatgtgagtgtatgtctgaggtggaatatctgtgtgcaggagggccttttcctccttgtgctgctattattttgatgtcagaaccatcccttggactggttgatattgttttaagcaattaaatatatcatgttcatgtttaagtgcctttgttttccctgtcttctaaatttcttccatatctttactcagtagggctctgcattctttatatgttttcatgatgattcattttagtgtcttaataaaattatattttgcctctatagaaaagattatgaactatgcagtatgctatgagctgtgatatagttcatgtatgcttgaaaatgaatgtttactttaggactttatcaccattcaggatatattgattgcctggtgtgcaaggagctgtgtgaggtgaaaatgatagggtaatggcaagcttggaaaatgatataggttttcatgttatgaccattaggaacaaggagtggttcacttatccctttagaatatttttcatattactctttgagatagatttaatgggcgtcccatggagagaggagtgaaggaaactaacagttctcagcttcaggaatatttatggaattatcaagaaccctagaggcagccataatggagccttttaaaaaggcactattttatattgttaattttaatgaacttttttgttgttgttgcttttttaaggcaatgaatttccaagggaagttaaagtatcttcatggacagaaaaagaaagggaaagatggatcaatacttccacctcagttggctttgtttgcgatagctactccacttcagccaccatccatacttgaaatccggaccaaaaattttatctttagaaccaaacacaaactagacttcacacctattggttgtgatgccaagtaagtgagactttttcacttttattttattggatgtacattatgtttcagtaagtctctcttagcatgtaaaacatacagtgtatgtaatattgtttattattagattggctattatcgtacattcttccagtgtagccttttacagtaaaataatttaatcaggctcacaaatcatctttttaatttttgcaatacttgtctcaaatgatgatgttcttatatattagtaaggtttattcttctgatgacatttatgttggtttgttttacatttttaaatggcacaaatgttatttgatttctagccccagaagttttagtaactttcagaaaattgtgagcaggagtctgatattaaacatttatatcatatcaaacatatcagtgcttttctcctttctaatgtgggaatgcagagaggtaattagaaaaaccttcttccctaaaaatagattataaaaacattccagatttttattaaagatgttctgttacccatacatctgctctattagattcatttttagcatactaatttccatggatttattcaggaaaagaaaataggctgaaactgaaatttgcaatcataagcaaagaagatcagtttacatggatgtgtttaatttcacatctacttatgtgaaattctaaatgtgaactaaaacatattgcagaaactagcgtaaaaccaatgaatttatcttggttatttcatttatgttaaatcttaatccattcttattttacctttttttattttaaacagaggaagaattgttttaggatatactgaagcagagctgtgcacgagaggctcaggttatcagtttattcatgcagctgatatgctttattgtgccgagtcccatatccgaagtaagttgtagttccttatgaacatgtcagaagaaaacggcatatactgttgtacatgtttcaaattcttacgtaatgtaaagtgtttaagtaaagtatatggataaacttctacttagtaacatatcattatgattaaccagggttacactctttgttcattaacttgtctacacctgccatgtagaaatattgttgtttagttattaaaaaatgaccattttggcccatgaagttttgcttgggaattttttaattacatcgttatcaattcataaatctatgttaatattgtaacaataatagtgttaataattctagtttaaaattataaagtattaggctgtaggaaaatattccctatttaaaatgaaaataattttttccccaacttatgttctctctatactttcctgtgttactagaattgtttggtacataatcttccctttaacatttaaaataataaatttaaaacaactctgaaaaactatttccatgccttttattattttttgtttaaaatttattgtctttggggataaaggaaatacatccagaactatgtcacaagagctttgttttaggaataatctttactatattgatttgggggtttgataatttaattttttaattttattttagtgattaagactggagaaagtggcatgatagttttccggcttcttacaaaaaacaaccgatggacttgggtccagtctaatgcacgcctgctttataaaaatggaagaccagattatatcattgtaactcagagaccactaacgtaagcacaaataatgtttcctgttttaacagttttgttttcataagtcctcttatgtgaaagcataaaaataattcaagcagactttagtctgtaaataaaaattgaaaagtttaattcatctagaaagaagagcacaggtgagagacattgagaagatagaattgacgaacttgattgagagctacatgtgcagagctatagaaagaataataaaactctagggttttatcttgggcatatgaaagacacatgaaaagctagtgtcattggtaaaaaagaagaaaaatataacaatgctttatttagaatatattctctaaacccagcagtgattttaagagtttcttacacatgctgcagatgagtcctttatcaaatatttgtattgcaaatgtttcctcccactctggagaattgatttttgtctgtagcttgaggtaaggattgattccccccagccattatacgtatacccaattgaccagtaacattgaaaagatgatttaccgagaaggtcattgtttcccggctgcgctgtattttgatcaggggattttgtctgtggttctctgtctggattgtgttgttctattaatagctccattagtgcagttgtctattttgtctagcattacactgtcttagttattctatctttattatatatttctatgtcagagtgtgtcattttgtttgttttgccttttttgttctccttcaagattgccttggttcttctttgccctctataattccatatacattttagaaagcagttgtctgaaaatctgttgagattttgagtgcaattaccttgaaactgtagatcatttggggagaattaacatctttttaatactgaatctttgagcccatgaacatgatgaatgtatgtatgtgtataagtacccatggaagtacatgagtatgtgtgtaccatatgtatatgagtgcatgggtatgtgtgtacctctacaaatttgtcacttctcccttgatcaatgtttctagaaggcactttttttaattagattttattagtctttattaggatccaacttttggtttattgatttttttctattttatacatttgttttcaattttaattatgtctgctcattattattttcttccttctactttctttgggtataatttatcattttttgcaacttttaaaaaatatatacttaaacatatatatcagtttccctttaagtacagcattacaaccctcatcttttgctatcttatttttattatttaattgaaaatactggctaatttgtttttatttttattcatgaattatttagaaatacagtgttactgtactttttggtgtttggggatttttctagttgcctttttatgattgacttttagcttaattccattgtagtcagaaaatattctctggatggatttcagtttttttgaaatttgtggtgacttattttatgatctaatacatggtctatgttggtaaaatatcccatgtaatcctatgaagaatacatgttctgtagtttgggagtatcttatttttatatatcagaagtctagtttgttaattgtgttcatatttgtatacatttgttgatattttatgtgcttctgttagttactaagacattttgttttcatttattactgaaggggggcatctttttacatctttctgttttttttttttttttgagatggagtctcgctctgtcgcccaggctggagtgcagtggcgggatctcggctcactgcaagctccgccacccgggttcacgccattctcctgcctcagcctcccaagtagctgggactacaggcgcccgccactacgcccggctaatttttttgtatttttagtagagatggggtttcaccgttttagccaggatggtctcaatctcctgacctcgtgatccgcccgcctcagcctcccaaagtgctgggattacaggcgtgagccaccgcgcccggccctttttacgtttttctatgacatttttcttttataaattacatttgtatcatttacctgtttttctgttgagttgtttgcctctctctcagactctattggagctctttattatggatatgaaattttataagtatattaaattataaatacattatgttacaaatattttctttaaaaattctattgcccgaggcgggcggatcacgaggtcaggagatcgagaccatcctggctaacacggtgaaaccccgtctctactaaaaatacaaaaaattagccgggcgttgtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaatctattgcaaaaatacaaatactttaatattaagtaattttcatattattatgccaatctgtctttatagctgctgggttttattatagaggttagttgtttcagattcttaactttctaattcctaatttttttatttttttattattattatttttgagacaggatcttactctgtcacctatgctggaatgcagtggcacaaatgtggctcactgaagccttaacctccaggctcaggcagtcctcctgcctcagactccagagtagctgaagactgtaggcatgtgccaccatgcccagctagtttttatttttttgtagaggtgagggtcttgccatgttgcccaggtttgtctcaaaatcctgggctcaagcaattcacacacatcagcctcccaaagtgctgcaattacaggcatgcaccaccatgcctggcccctaaattctcgtagtctgtttttatgtgtagatatttattccacacaaatttattatttttttctttttttgcagggtgtcaggtagggatgtaacctgaccatggaattaactaagttattttttaaaaattaaatcatttaaatatgcttgtctgaaaaacaattttatagcaccagtcatgagaataattgaggtgaaaataaaatatgtccctttctgaattcaattacaatgtattttgctttatgtttttcttttttaaattatttttattttaaaatgtttgatagaatttttttctaagacttttttgtacacaattttagagatgaggaaggaacagagcatttacgaaaacgaaatacgaagttgccttttatgtttaccactggagaagctgtgttgtatgaggcaaccaacccttttcctgccataatggatcccttaccactaaggactaaaaatggcactagtggaaaagactctgctaccacatccactctaagcaaggactctctcaatcctagttccctcctggctgccatgatgcaacaagatgagtctatttatctctatcctgcttcaagtacttcaagtactgcaccttttgaaaacaactttttcaacgaatctatgaatgaatgcagaaattggcaagataatactgcaccgatgggaaatgatactatcctgaaacatgagcaaattgaccagcctcaggatgtgaactcatttgctggaggtcacccagggctctttcaagatagtaaaaacagtgacttgtacagcataatgaaaaacctaggcattgattttgaagacatcagacacatgcagaatgaaaaatttttcagaaatgatttttctggtgaggttgacttcagagacattgacttaacggatgaaatcctgacgtatgtccaagattctttaagtaagtctcccttcataccttcagattatcaacagcaacagtccttggctctgaactcaagctgtatggtacaggaacacctacatctagaacagcaacagcaacatcaccaaaagcaagtagtagtggagccacagcaacagctgtgtcagaagatgaagcacatgcaagttaatggcatgtttgaaaattggaactctaaccaattcgtgcctttcaattgtccacagcaagacccacaacaatataatgtctttacagacttacatgggatcagtcaagagttcccctacaaatctgaaatggattctatgccttatacacagaactttatttcctgtaatcagcctgtattaccacaacattccaaatgtacagagctggactaccctatggggagttttgaaccatccccataccccactacttctagtttagaagattttgtcacttgtttacaacttcctgaaaaccaaaagcatggattaaatccacagtcagccataataactcctcagacatgttatgctggggccgtgtcgatgtatcagtgccagccagaacctcagcacacccacgtgggtcagatgcagtacaatccagtactgccaggccaacaggcatttttaaacaaggtaagggtgttatcaaactgaattaaatctttcagtgattctttttaccttatagacatgttacacattttttatgtcagctgattttaatcggttatctacagcattcatggagacagcattttttattatatctgtgactaccttttttttttttacaagcctgtactttttccagtatgttactaatatatcattcacctgattcatgagggagaaagatatcaaggaatgaagcaacatgaatgtgtccttaatataagatgacctaaattaccaggtgaaattagtttttagaagtattttgtttaaaatagataatttggtttattctttctggattctttaaaaattatatggctatttaaaaattcaagctttaaaaaacgtattgcaatttttaagaataatttcttcaaagctctatttttttatatatgtttgaaattgagttaaactcaaatttaagtgtgctttcttacaatgcctctgaaaccctagattaattatatccctggaattcagtcctaggcacctccatgttctctagctattcctccacattacctcccctatcctcatctcatcctttaaggtagaatggctttcttttctggctttcttaaaagaggtaactcagctggctttctgtcatggaaatcaagcttgatagtgcatttttgttgtttaaatgtgtcatcagaatccgtctggcagtgagcacactttaaatctaaaaatgatcacttaaaaaaaaaaagttaacataatgtcagtaactgctgtctctggccactcaggaatacatcatgtttgcatttatgctttttccattagaaaatatttagttcattttaaagtatatttaagtttagttttaaagaatatcttgactaaaattaagctccttgacccctgtttactctgtattagagtataataattaaaagtatgacctgaagctttatctttaattgtattttctggctttttcatacattttgcttgtctaatcgtatatgagctttttaatagaaaaggacagtgaaaatttttcttattccttacatccttcaattatattaaaattgaataatattcagttatagtccgtctcacaaaattgctatgaaagtatattttactcttgagtaaagcaaattgtacagaagttaattctgtaaaattacattttgaataaggagttgcatgagtaccacataagttctttgcagtgttttcccctcactacttttcactgcttctttgtaaataaccaaataattctatagacctacatatgttccagagtacatgttattgagctaagacactcaatattgagccactgagtagctgttcagcacttgaaatgtggctagtccaaattgagatgtgctgtgtgaagtacacattggatttttggattttgaagacttggcttgaaaaaagaatgtaaaatatctcatcttttattattgatttcatgttgaaatgattagttttttcagtagccgcattacaaaagtaaaaagaaacaggtaaaattaactttagaaatgtattttatttaatctactgtagccaaaaatttaagttctgtatgtggctcacattatatttctattggattacactgctgtgtacagtatgtttaaagagaatggtgacatgaattgtgttatgagtaatgagaaaaaatcattttaaactcaccattatctggccaggtaatactaactttttatttaaagaatttacagtgttgccattcattgaagatacaggttatatgatttttactatagattttatatatgttttggaggatctgtgaagtaattaacattttgattactgaagccagttatgtaggctttacaaaggtagattttatttgaagcaattaaggatatgattttaatctgttttaaagtttccagaacgtccactaactaaaatataaaggctctgtaatctataaaactctacagagctatacatcttcatgtccttcctttttatttttcttttttctactagcagttatagaaaccagattcattgcagtgtaagaaaacaagacagagcattttcttttggtaacttgattctgtaattagaactatgctttcagtagtattcattaattaaaagtatattatgaataagaaatcggttaagaaaatcatacctgtggtgtaatattttaggaatatttagaaacatttagaaaatcagaagctgccttttttggaaaagttttgcattccagtgtaagattcctgaatataatcaattcattgatacctataacttcaaacctggtcaaagcaaacctacttatgatagagaatatttaactgtaatttgtgacttgtgctgtttgacccatcaattcctacctgacccaaaggcaatctgaaatgagacagctgcatcactcatctgtaccatgttcaaaatttcctgtcaaattaatggaaaaacaggttataaatgcaactaatacataatatgtcctcagtatgtcttcactgtgtgaaagatttaaaatttagcaacagtaaaggaacttgaagtttacaactctcaggggtaagattttaaaaatacatgttaatgttatttactggcttaagatacttggaagatctattccaataagttgcatcaccatttttgttttcagtttcagaatggagttttaaatgaaacatatccagctgaattaaataacataaataacactcagactaccacacatcttcagccacttcatcatccgtcagaagccagaccttttcctgatttgacatccagtggattcctgtaattccaagcccaattttgaccctggtttttggattaaattagtttgtgaaggattatggaaaaataaaactgtcactgttggacgtcagcaagttcacatggaggcattgatgcatgctattcacaattattccaaaccaaattttaatttttgcttttagaaaagggagtttaaaaatggtatcaaaattacatatactacagtcaagatagaaagggtgctgccacggagtggtgaggtaccgtctacatttcacattattctgggcaccacaaaatatacaaaactttatcagggaaactaagattcttttaaattagaaaatattctctatttgaattatttctgtcacagtaaaaataaaatactttgagttttgagctactggattcttattagttccccaaatacaaagttagagaactaaactagtttttcctatcatgttaacctctgcttttatctcagatgttaaaataaatggtttggtgctttttataaaaagataatctcagtgctttcctccttcactgtttcatctaagtgcctcacatttttttctacctataacactctaggatgtatattttatataaagtattctttttcttttttaaattaatatctttctgcacacaaatattatttgtgtttcctaaatccaaccattttcattaattcaggcatattttaactccactgcttacctactttcttcaggtaaagggcaaataatgatcgaaaaaataattatttattacataatttagttgtttctagactataaatgttgctatgtgccttatgttgaaaaaatttaaaagtaaaatgtctttccaaattatttcttaattattataaaaatattaagacaatagcacttaaattcctcaacagtgttttcagaagaaataaatataccactctttacctttattgatatctccatgatgatagttgaatgttgcaatgtgaaaaatctgctgttaactgcaaccttgtttattaaattgcaagaagctttatttctagctttttaattaagcaaagcacccatttcaatgtgtataaattgtctttaaaaactgttttagacctataatccttgataatatattgtgttgactttataaatttcgcttcttagaacagtggaaactatgtgtttttctcatatttgaggagtgttaagattgcagatagcaaggtttggtgcaaagtattgtaatgagtgaattgaatggtgcattgtatagatataatgaacaaaattatttgtaagatatttgcagtttttcattttaaaaagtccataccttatatatgcacttaatttgttggggctttacatactttatcaatgtgtctttctaagaaatcaagtaatgaatccaactgcttaaagttggtattaataaaaagacaaccacatagttcgtttaccttcaaactttaggtttttttaatgatatactgatcttcattaccaataggcaaattaatcaccctaccaactttactgtcctaacatggtttaaaagaaaaaatgacaccatcttttattcttttttttttttttttttgagagagagtcttactctgccgcccaaactggagtgcagtggcacaatcttggctcactgcaacctctacctcctgggttcaagtgattctcttgcctcagcctcccgagttgctgggattacaggcatgtgccaccatgcccagctaatttttgtatttttagtagaaacgggtttcaccatgttggccagactggtctcaaactcctgacctcaggtgagcctcccaccttggcctcccaaagtgctgggattacaggcgtgagccactgcattcagctcttcttttctttagatatgagagctgaagagcttagacacattttgcatgtattatttgaaaatctgatggaatcccaaactgagatgtattaaaatacaatttttggccgggtgcagtggctcacgcctgtaatcccagcacttggggagggcgaggagggtggatcacgaggtcaagagatggagaccatcctgaccaacatggtgaaaccctgtctctactaaaaatacagaaattagctgggcatggtggcgtgagcctgtagtcctagctactcaggaggctgaggcaggagaatagcctgaacctgggaatcggaggttgcagagccaagatcgccccactgcactccagcctggcaatagaccgagactccgtctccaaaaaaaaaaaaaatacaatttttatttcttttactttttttagtaagttaatgtatataaaaatggcttcggacaaaatatctctgagttctgtgtattttcagtcaaaactttaaacctgtagaatcaatttaagtgttggaaaaaatttgtctgaaacatttcataatttgtttccagcatgaggtatctaaggatttagaccagaggtctagattaatactctatttttacatttaaaccttttattataagtcttacataaaccatttttgttactctcttccacatgttactggataaattgtttagtggaaaataggctttttaatcatgaatatgatgacaatcagttatacagttataaaattaaaagtttgaaaagcaatattgtatatttttatctatataaaataactaaaatgtatctaagaataataaaatcacgttaaaccaaatacacgtttgtctgtattgttaagtgccaaacaaaggatacttagtgcactgctacattgtgggatttatttctagatgatgtgcacatctaaggatatggatgtgtctaatttagtcttttcctgtaccaggtttttcttacaatacctgaagacttaccagtattctagtgtattatgaagctttcaacattactatgcacaaactagtgtttttcgatgttactaaattttaggtaaatgctttcatggcttttttcttcaaaatgttactgcttacatatatcatgcatagatttttgcttaaagtatgatttataatatcctcattatcaaagttgtatacaataatatataataaaataacaaatatgaataatatgttttaatgtaaattctttctggtccacgtaaaggaaattatttattctgtagtattataactatgttagatgagggcaatctacaatacttagggatatgttaagtcagtaattcataaacttcttatacaattttgccccccaatgtctgacctttatctggatataaaaaacactctcagtagcttcataaattaaaatgcttctgaaatgaacttttttaaagccctgtgttatcagtgtagtagtgtgtcttagattaaaatccaaaatcctattttaatattttaagaatatttctgaagaaattcgaaataacccttgttagctgtattttgtgcttagtttagaaaaaccattgcccaaacttagtatttctgtttaataagtataaatgatacagaagcctttggccttaaattcataactgttgaacattcatggaaaaccctgcaattagaattgattgaagaagaattcctgagaaaatgttttcattcttgtgacagttatttttctattagttttatatttgttctttacaattaggcatttttctcaactagcatatcataagttagcatcatacttaattctgaacattttagactaatcctgagtctttaagaattacataaaatatttagttttaactatttgatctgaaaaaaatcaagtaaaaatcctgataacctgagtgcatctctgcttgcgcttaggtgatttctgtcaccatgaatgactctagcttgtccaatttcaccagctctaccaaacaccgacccagggatgttggccactgacagggctggatgacatctctcatttctttcactgtctgcagatgaccttgcttccgtttttactaataaaatcaaggatatcatcctaagtttgtaccttcacctcagcaattcctctatccttggacttacctccagtatgtgaggaggagagtttcctgaactccagggttagcccccgtcctctctcgttctcatgcacacagcttcgacacctgctttctgagaggctctccttctctgtaggatttcctgtgaataggtcctcctccatcctggaaaaaaattacttgaacctgcactttcttctctattaaattacttctttaccttcttcctttgtaacaacagttttgatctcctgagatctggttttgttttccatccttccattatattgcagtgttgcggttcactaaacttcttaccataggctcattttctatggccctgcaaccaaactgattacactttcaatgaacttttttcttcccttccatgacattagttgtcctgtaagctcctattatcccttttctttcctttgttaaccactctttcctcctcccacctggcagcaggcttagttttgaccatttgtggctctttctgtacatactgtctaagaagaagtgattcaatgccttacctctgattgacatttgtgaagcaattctttccctgagagagcagcatagcatagccaaactaaacacacagactctggagtcagactactaggtataaatcctggctttgccacaaataagatgtcattgagaaggtttcttactttctcttagcctaagatgccttttctgtaaactaaggctaacagtacctgcctcactggattgctggaggattcagtgatttatataaaatcacttagctgccagtagccaaaactggaataatttgagcaactaaataagtgatgatagcattagattacagcacaaagaataaagtaaatatccatgaatccatactaatataaataaaatggttgaaaaataaatgggggagaaggagcacatctttcctatagaagaatcccaaataatattggtagctactatgccctctgatgcatgagcttagttctcctcccctggaaggatgagttagacttaatgacttgctttcaaggaatagagtacagacagagaagaaaataactttacattgttgaaatctggcaagcactactttaaccaagtaatcaaggttaacatcaccagtgaaaagtcatgttgatataacatgtattatctgatatgatactttgagaagtgtacatctcaaagctccctgattttcttaaaaacacatagtctaattatgacaaaacatcaaacgcaaattcagggacattccacaaaatttctgagaggattttttaaagtgtcactgtcacagaaagagactgaataattatcacagagcagaggaggctaaggaggcatgatgactgaacttaatgtgatatctccgattgcatccttcatagaaaaagggcattactgagaatctgcagaactctaagtctagttaatagtaccacatcattgttaattttttggttttgaccaatgtaccatggctatactacgttagaggtacctggctgaagagagtaaaggaactctatatccttttgacttttctgtaaatctaaaattattccacagtagattttactttttaataaaagtacagtttttattgccacatagcaagtatctttatgtctctcattactattttcctgtatcttcacaacctcctcttagttggaggtaaagctatacattgacatcagtccccattaactactgatttgacgaatatctttttttttttaatttaagttctggggtacatgtacagaatgtgcaggtttgttacataggtatacacgtgccatggtggtgtgctgcgcccatcaacccgtgatctacattagatatttctcctaatggtatccctcccctagccccccactggtgtgtgatgttcccctccctgtgtccatgtgttctcattgttcaactcccacttatgagtgagaacatgcggtgtttagttttctgttcttgtgttagtctgctgagaatgatggtttccagcttcatccatgtccctgcaaaggacaggaactcatccttttttatggctgcatagtattccatgctgccagttttcccaacaccatttattaagtagggaatcctttccccattgcttatttttgtcaggtttgtcaaagattggatggttgtagatgtgtggtgttacttctgaggcctctgttctgttccattggtgtatatatctgttttggtaccagtaccatgctgttttggtgactgtagccttgtagtataccacattctctttatccagtctgtcattgatgggcatttgggttggttccaagtctttgctattgtgaacagtgctgcagtaaacatacgtgttcatatgtctttatagtagaatgatttataatcctttgggtatataccctggaatgggattgctgggtcaaatggtatttctagttctagatcctcgaggaatcaccacgctgtcttccacaatggttgaactaatttactctcccaccaacagtgtaaaagcattctgatttctccatatcctctccagcatctgttgcttcctgactttttaatgattgccattctaactggcatgagatggtatctcattgtggttttgatttgcatttctctaatgaccagtgatgatgagctttttttcatatgtttgttggcagcataaatgtcttcttttcagaagtgtctgttcatatccttctcccactttttgatggggttgtttgttttttttttcttatacatttgtttaagttctttgtagattctggatattagccctttgtcaaatgtataggttgcaaaaattttctcccattctgtaggctgcctgttcacgctgatgatagtttcttttgctgcgtagacgctctttagtttaattagatcccatttgtcaattttggcttttgttaccattgcttttggtgttttagtcatgaaatctttgcccatgcctatgttctgaatggtattgcctaggttttcttctagggtttttatggttttaggtcttacatttaagtctttaatccatcttgagttaatttttaaataaggtataaggaaggggtccactttcagttttctgtaccattggtgtatatatctgttttggtaccagtaccatgctgttttagttactgtagccttgtagtatggtttgaagccaggtagcatgatgcctccagctttgttctttttgcttaggactgtcttggctatgcgggctcttttttggttccatacgaaatttaaagtagttttttctaattctgtaaagaaaatcactggtagcttgatggggatagcagtgaatctataaattactttcagcagtatggccattttcacaatctttactcttcctatccatgagcatggaatgtttttccatttgtttgtgtcctctcatttccttgtgcagtggtttgcagttctccttgaaaaggtccttcacatcgcttgtaagttgtattcctaggtattttattctctttgaagcagttgtgaatgggagttcactcatgatttcactctctattattggtgtgtaggaatgcttgtgatttttgcacattgattttgtatcctgagactctgctgaagttgcttatcagcttaaggagattttgggtgagatgatggggttttctaaatatatgatcatgttatctgcaaacagagacagttttacttcctcttttcctatttgaacacactttatttatttatcttgcctgattgccctggccagaacttccaatactatgttgaataggagtggtgagagagggcatctttgtctcggcctgaaattttctttttttgttgtgtctcagccagcttttgatatcaggatgatgctggcctcataaaatgagttagggaggagtctctctttttctattgcttggaatcgtttcaaaaggaatggtaccagctcctctttgtacctctggtagaattcagctgtgaatctgtctggtcctggactttttttggttggtaggctattaattactgcctcaatttcagaacttgttattgttctattcagggattcaacttattactggtttagtcatgggagggtgtatgtgtccaggaatttatccatttcttctagattttctgttttatttgtgtagaggtgtttataatattctctgatggtagtttgtatttctgtgggatcagtggtgatatcccctttatcattttttattgcgtctatttgattcttttctcttttcttctgtattagtctggctagcggtctattttgttgatcttttcagaaaaccagctcctggcttcattgatttttagaaaggttttttgtgtctctatctctttcagttccgctctgatcttagttatttcttgtcttctgctggcttttgaatttatttgctcttgcttctctagttcttttaattgtgatgttagggtgtcaattttagatcttttctgctttctcttgtgggagcttagtgctataaatttccctctacacactgctttagctgtgtcccagatattctggtacgttgtgtctttgttctcattggtttcaaagaacatctttatttctgccttcattttgttatttacccagtagtcattcaagagcaggttgttcagtttccatgtagttgtgctgtttttagtgagtttcttaatcctgagttctaatttgattgcactgtggtctgaaagactgtttgttatgatttccgttcttttgcatttgctgaggagtgttttacttccaattatgtggtcaattttagaataagtgtgatgtagtgctgagaagaatgtatactctgttgatttggggtggagagtttgtcttgcagatgtctattaggttcgcttggtctagagctgagttcaagtcctgaatatccttgttaattttctgtcttgtttatctgtctaatattgacactggggtgttaaagtctcccagtattattgtgtgggaatctaagtctctttgtaggtctcttgctttattaatctgggtgctcctgtattgggcgcatatatatttaggatagttagctcttcttgttgcattgatccctttaccattatgtaaatgcccttgtctcttttgatcactggtggtttaaagtctgttttatcagactaggattgcaactcctgctttttttgctttccatttgcttggtaaatattactccatccctttattttgagcctatgtgtgtctttacatgtgagatggatctcctgaatatagcacacggatgggtcttgactctttatccaatttgctagcctacgtcttttaattggggcatttagcccatttacatttaaggttaatattgttatgtgtgaatttgatcctgtcattatgctgctagctggttattttgcccattacttgatgcagtttcttcacagtgtcaatggtctttacaatttggtacatttttgcagtggctggtaccagctgttcctttccatttttagtgcttccttcaggacttcttgtaaggcaggcctggtggtgacaaaatcagcatttccttgtttgtaaaggattttatttctccttcatttatgaagcttagtttggctggatatgaaattctgtgttgaaaattattttctttaagaatgttgagtattggcccccactatcttctggcttgtaggatttctgctgagagatccgctgttagtctgatgagcttccctttgtgggtatcccagcctttctctctggctgcccttaacaatttctccttcatttcaatcttgatgaatctgatgattatgtgtcttggggttgctcttcttggggagtatcttcatggtgttctctgtatttcctgaatttgaatgttggcctgtcttgctagtttggggaagttctcctggataatatactgaagagtggtttccaacttggttccattctccatgtcactttcaggtacaccaatcaaatgtagatttggtcttttcatatagtcccatatttcttggaggctttgttgattccttttcattcttttttctctaatcctgtcttcatgctttatttcattaagttgatcttcaatctctgatatcctttcttccgcttgatcaattcagctattgatacttgtgtatgcttcacaaagttctcatgctgtgtttttcagctccatcaggtcatttatgttcttctctaaactggttattctagttagcaatttgtctaaccttttttcaaggttcttagcttccttgcattgggttagaacatgctcctttagctcagaggagtttgttattacccaccttctgaagcttacttctgtcaattcatcaaactcattctccatccagttttgttccctttctggcgaggagttgtgatcctttggagtagaagaggtattctggtttttggaattttcagcctttttgcactggtttctccccatcttcatggatttatctacgtttggtctttgatgttggtggccttcggatggggtttctgtgtggacatccttttcaatgatgttgatgctcttcctctttgttagttttccttccaacagtcaggcccttctgctgcagatctgttggagtttgctggaggtccactccagaccatttgcctgggtatcaccagctgagtccgcagaacagcaaagattgttgcctgttccttcctctggaagcttcaccccaggggggcattcaccagatgccagccagagctctcctgtgtgaagtgtctgttggcccctcctggaaggtgtctccccctcaggaggcacaggggtcagggacccacttgagaaggcaatttgtcccttaccagagctcgaacactatgctcagagaactgctctcttcagagctggcaggcaggaacgtttaagtctgctgaagctgcacccacagccaccccttcccccaggtgctctgtcccaggagatgggggttttatctataagcccctgactggggctgctgcctttctttcagagatgccctgcccagagaggagggatctagagaggcagtctggctacagtggctttgctgagctgaggagggctccacccagttggaacttccccatggcttgctttacattgtgaggggaaaaccacctactcaagcctcagtaatggtgggcaccccttccccaaccaagctcaagcatcctgggtcgacttcagactgctatgctggcagtgagaatttcaagccagtggatcttagcttgctgggctccgtgggggtgggatccgctgagctagaccacttggctccctggcttcagcctcctttccaggggagtgaatggttctgtctcgctggtgttccaggtgccactggggtatgaaaaacaaacaaacaaaaaacctcctgcagctagctcagtgtctgccctaaaggctgctcagttttatgcttgaaacccagggccctggtagcgtagacacccaggggaatctccggatctgtgggttgtgaaggccatgggaaacgcatagtctctgggcgggagtgcagtgttcctcatggcacagtcccacatggcttcctttggcttggggagggagttccccgaccccttgcattttccaggtgaagtgatgccccaccctgtttcagcttgccctccatggactgcacccactttttaacctcctaaaacgttcctttcttctttgatctgctaacatcatccttatcaatggcccttcttggtttgttctcatagcttctacacatcaactataataacctatttttctgttccaactaagtacagccacacctcagagtttgagcatttgtaactgccttacctctatcaacttagtatctccttttccaatcttttcttccttgttcaactagctctgcaccctccttgtgctccttgagtatacattgttttttcatagtccagcagcctggacctcagtttcaggatttcagaaatatttttgcttatatcctggatgttctcacttattagtaactgctgatccagtccatggccctggccaaaaagactctgttttcctgatatgcagtcttgctagagaaagtcacaaaacagaaataattggcttcaccacagtcttatcatgtcagtggcagagactgacagttgcctacagagatatcttcccttccttagtaagagaaccctgacttttcactggttacattgaggaaataaaagactacattttccagcctcctttgtagatacacataactaacataacttctgcccaaatatatgaaagcaaaaattttgtataatacttccaggaaggctgcttaaagggacttaatacaactaaaatgagcaatttttgcctttctgcttttcctctttgtaaccaacacatatgtatctagagagccaccagccactttgaaccatgatgacagaagccatgaactaggatggtgaagaaaaaatagaatgagcctggtttctcttgacttggaactaccaaacagtcaatccctagtctgcctactacctctgggcttcctgtacataagagataaacagagtctctgccccaccaccacccctaggtattttcatctcactctagaatgacattatctccaacttgactgaaaacaatctgaaataatcttcagttttctactttatgcctttgtattcctttctatcaactatctcctcagattttccttacctctttttgttgcaacttctgccattaaatacatgagtttcttccctttttttttctaaaatatgttcttattatggttttcttcttctataatggcagaatatctccagtttttatatttttatttttactgttttttaattgatatataatagatgcagacattttcaaggtccatgtaataatttgatgtatttatataatcaaatcaggataattggggcatccatcatctcaaatatttatctgctctttatgctaggaacattcaaattgttctagctattttgaaatgtataatagtgttaact

SEQ ID NO: 2 - DNA, 6247 bp, Homo sapiens
agtggctggggagtcccgtcgacgctctgttccgagagcgtgccccggaccgccagctcagaacaggggcagccgtgtagccgaacggaagctgggagcagccgggactggtggcccgcgcccgagctccgcaggcgggaagcaccctggatttaggaagtcccgggagcagcgcggcggcacctccctcacccaaggggccgcggcgacggtcacggggcgcggcgccaccgtgagcgacccaggccaggattctaaatagacggcccaggctcctcctccgcccgggccgcctcacctgcgggcattgccgcgccgcctccgccggtgtagacggcacctgcgccgccttgctcgcgggtctccgcccctcgcccaccctcactgcgccaggcccaggcagctcacctgtactggcgcgggctgcggaagcctgcgtgagccgaggcgttgaggcgcggcgcccacgccactgtcccgagaggacgcaggtggagcgggcgcggcttcgcggaacccggcgccggccgccgcagtggtcccagcctacaccgggttccggggacccggccgccagtgcccggggagtagccgccgccgtcggctgggcaccatgaacagcagcagcgccaacatcacctacgccagtcgcaagcggcggaagccggtgcagaaaacagtaaagccaatcccagctgaaggaatcaagtcaaatccttccaagcggcatagagaccgacttaatacagagttggaccgtttggctagcctgctgcctttcccacaagatgttattaataagttggacaaactttcagttcttaggctcagcgtcagttacctgagagccaagagcttctttgatgttgcattaaaatcctcccctactgaaagaaacggaggccaggataactgtagagcagcaaatttcagagaaggcctgaacttacaagaaggagaattcttattacaggctctgaatggctttgtattagttgtcactacagatgctttggtcttttatgcttcttctactatacaagattatctagggtttcagcagtctgatgtcatacatcagagtgtatatgaacttatccataccgaagaccgagctgaatttcagcgtcagctacactgggcattaaatccttctcagtgtacagagtctggacaaggaattgaagaagccactggtctcccccagacagtagtctgttataacccagaccagattcctccagaaaactctcctttaatggagaggtgcttcatatgtcgtctaaggtgtctgctggataattcatctggttttctggcaatgaatttccaagggaagttaaagtatcttcatggacagaaaaagaaagggaaagatggatcaatacttccacctcagttggctttgtttgcgatagctactccacttcagccaccatccatacttgaaatccggaccaaaaattttatctttagaaccaaacacaaactagacttcacacctattggttgtgatgccaaaggaagaattgttttaggatatactgaagcagagctgtgcacgagaggctcaggttatcagtttattcatgcagctgatatgctttattgtgccgagtcccatatccgaatgattaagactggagaaagtggcatgatagttttccggcttcttacaaaaaacaaccgatggacttgggtccagtctaatgcacgcctgctttataaaaatggaagaccagattatatcattgtaactcagagaccactaacagatgaggaaggaacagagcatttacgaaaacgaaatacgaagttgccttttatgtttaccactggagaagctgtgttgtatgaggcaaccaacccttttcctgccataatggatcccttaccactaaggactaaaaatggcactagtggaaaagactctgctaccacatccactctaagcaaggactctctcaatcctagttccctcctggctgccatgatgcaacaagatgagtctatttatctctatcctgcttcaagtacttcaagtactgcaccttttgaaaacaactttttcaacgaatctatgaatgaatgcagaaattggcaagataatactgcaccgatgggaaatgatactatcctgaaacatgagcaaattgaccagcctcaggatgtgaactcatttgctggaggtcacccagggctctttcaagatagtaaaaacagtgacttgtacagcataatgaaaaacctaggcattgattttgaagacatcagacacatgcagaatgaaaaatttttcagaaatgatttttctggtgaggttgacttcagagacattgacttaacggatgaaatcctgacgtatgtccaagattctttaagtaagtctcccttcataccttcagattatcaacagcaacagtccttggctctgaactcaagctgtatggtacaggaacacctacatctagaacagcaacagcaacatcaccaaaagcaagtagtagtggagccacagcaacagctgtgtcagaagatgaagcacatgcaagttaatggcatgtttgaaaattggaactctaaccaattcgtgcctttcaattgtccacagcaagacccacaacaatataatgtctttacagacttacatgggatcagtcaagagttcccctacaaatctgaaatggattctatgccttatacacagaactttatttcctgtaatcagcctgtattaccacaacattccaaatgtacagagctggactaccctatggggagttttgaaccatccccataccccactacttctagtttagaagattttgtcacttgtttacaacttcctgaaaaccaaaagcatggattaaatccacagtcagccataataactcctcagacatgttatgctggggccgtgtcgatgtatcagtgccagccagaacctcagcacacccacgtgggtcagatgcagtacaatccagtactgccaggccaacaggcatttttaaacaagtttcagaatggagttttaaatgaaacatatccagctgaattaaataacataaataacactcagactaccacacatcttcagccacttcatcatccgtcagaagccagaccttttcctgatttgacatccagtggattcctgtaattccaagcccaattttgaccctggtttttggattaaattagtttgtgaaggattatggaaaaataaaactgtcactgttggacgtcagcaagttcacatggaggcattgatgcatgctattcacaattattccaaaccaaattttaatttttgcttttagaaaagggagtttaaaaatggtatcaaaattacatatactacagtcaagatagaaagggtgctgccacggagtggtgaggtaccgtctacatttcacattattctgggcaccacaaaatatacaaaactttatcagggaaactaagattcttttaaattagaaaatattctctatttgaattatttctgtcacagtaaaaataaaatactttgagttttgagctactggattcttattagttccccaaatacaaagttagagaactaaactagtttttcctatcatgttaacctctgcttttatctcagatgttaaaataaatggtttggtgctttttataaaaagataatctcagtgctttcctccttcactgtttcatctaagtgcctcacatttttttctacctataacactctaggatgtatattttatataaagtattctttttcttttttaaattaatatctttctgcacacaaatattatttgtgtttcctaaatccaaccattttcattaattcaggcatattttaactccactgcttacctactttcttcaggtaaagggcaaataatgatcgaaaaaataattatttattacataatttagttgtttctagactataaatgttgctatgtgccttatgttgaaaaaatttaaaagtaaaatgtctttccaaattatttcttaattattataaaaatattaagacaatagcacttaaattcctcaacagtgttttcagaagaaataaatataccactctttacctttattgatatctccatgatgatagttgaatgttgcaatgtgaaaaatctgctgttaactgcaaccttgtttattaaattgcaagaagctttatttctagctttttaattaagcaaagcacccatttcaatgtgtataaattgtctttaaaaactgttttagacctataatccttgataatatattgtgttgactttataaatttcgcttcttagaacagtggaaactatgtgtttttctcatatttgaggagtgttaagattgcagatagcaaggtttggtgcaaagtattgtaatgagtgaattgaatggtgcattgtatagatataatgaacaaaattatttgtaagatatttgcagtttttcattttaaaaagtccataccttatatatgcacttaatttgttggggctttacatactttatcaatgtgtctttctaagaaatcaagtaatgaatccaactgcttaaagttggtattaataaaaagacaaccacatagttcgtttaccttcaaactttaggtttttttaatgatatactgatcttcattaccaataggcaaattaatcaccctaccaactttactgtcctaacatggtttaaaagaaaaaatgacaccatcttttattcttttttttttttttttttgagagagagtcttactctgccgcccaaactggagtgcagtggcacaatcttggctcactgcaacctctacctcctgggttcaagtgattctcttgcctcagcctcccgagttgctgggattacaggcatgtgccaccatgcccagctaatttttgtatttttagtagaaacgggtttcaccatgttggccagactggtctcaaactcctgacctcaggtgagcctcccaccttggcctcccaaagtgctgggattacaggcgtgagccactgcattcagctcttcttttctttagatatgagagctgaagagcttagacacattttgcatgtattatttgaaaatctgatggaatcccaaactgagatgtattaaaatacaatttttggccgggtgcagtggctcacgcctgtaatcccagcacttggggagggcgaggagggtggatcacgaggtcaagagatggagaccatcctgaccaacatggtgaaaccctgtctctactaaaaatacagaaattagctgggcatggtggcgtgagcctgtagtcctagctactcaggaggctgaggcaggagaatagcctgaacctgggaatcggaggttgcagagccaagatcgccccactgcactccagcctggcaatagaccgagactccgtctccaaaaaaaaaaaaaatacaatttttatttcttttactttttttagtaagttaatgtatataaaaatggcttcggacaaaatatctctgagttctgtgtattttcagtcaaaactttaaacctgtagaatcaatttaagtgttggaaaaaatttgtctgaaacatttcataatttgtttccagcatgaggtatctaaggatttagaccagaggtctagattaatactctatttttacatttaaaccttttattataagtcttacataaaccatttttgttactctcttccacatgttactggataaattgtttagtggaaaataggctttttaatcatgaatatgatgacaatcagttatacagttataaaattaaaagtttgaaaagcaatattgtatatttttatctatataaaataactaaaatgtatctaagaataataaaatcacgttaaaccaaatacacgtttgtctgtattgttaagtgccaaacaaaggatacttagtgcactgctacattgtgggatttatttctagatgatgtgcacatctaaggatatggatgtgtctaatttagtcttttcctgtaccaggtttttcttacaatacctgaagacttaccagtattctagtgtattatgaagctttcaacattactatgcacaaactagtgtttttcgatgttactaaattttaggtaaatgctttcatggcttttttcttcaaaatgttactgcttacatatatcatgcatagatttttgcttaaagtatgatttataatatcctcattatcaaagttgtatacaataatatataataaaataacaaatatgaataat

SEQ ID NO: 3 - DNA, 601 bp, Homo sapiens
  misc_feature (301)..(301): Y = C/T
cattctgttttacaggacactccaccctcagctatatccccttgattaattatgtaaccagatctccttcatcaacttaccgattaggtaatggcaggtatttctgatgcttggtatggggtctgagtgaggagggtcctaaaaatattacttatgcagctgttttgcatagcattaaagtgaaaagctttaacttgcagtacaagttaacatttgttccagacttttttttttaaactattattttagcatgtaagccttatagacataaatcctgtctactgatacattataaagtctyagaaaagtcagtgattatatacaggaaagtagataaaggagaaatttcaaatgcataagaacaagcaaaaaggtattcgtaaggtattagaaactattagcattttagtataaataactggtgaatacagcaaaatgaataatttgtggttagtataaatcagctaaattcttgtaatgcacaactaactacacatattcttcagcccacggaggccatacaatggagatttgggattctaactttgttttcaaaatggagaagtgcagaaactttgaatcttttaaaatttatcttcca

SEQ ID NO: 4 - DNA, 643 bp, Homo sapiens
  misc_feature (307)..(307): Y = C/T
aaagctgggtgcctaatatgtatctgtcctgacctcccatggaaacaattatcaggcttcagatattttgtctctcaattttttaacttgaaagtacatggctatttatttttgcacttattttttgtttttattgtgcaatttttcaacatatggcaaagttgaaagaataccacaaatgtttgtatacctttcataattgtgtatatgtgtatgtgtgtgtatatatatatgtatatatgtatatatatatatgtatatatgtgtatatatatatatgtgtgtatatatatatatatatatatayatatatatatatgaatgttgcagcatgcatttcctgagaataaggatcttctctttattctagaggtatatacctctacaggtgatagaggtatataaccacaatacctctatcacctgtaaaatcccgattccaggacacaacatagataaattaaataaaaatttttgtagtggagccaaggatccgtaatttttacagttctcaagtgactacaatatgcaacaaatgttgagaaccactgtccacacattaattaaatttgttaaatattttcagtaaagaatacattttgtttcttaatatgaataagaatgatagccttttaaagtttag

SEQ ID NO: 5 - DNA, 579 bp, Homo sapiens
  misc_feature (145)..(145): M = A/C
atcaaatggtcataccacagatgactcaagttttattcccacatgcatttaaccatatccatgtttcctaatacggtactttccttccttagacatctaagctcagatttcccctactccctaaatgccacatctcttcatatcmcatgctttgaattggtcaaggaaaaaaaaattcatgaggaataccgaatagtggtaaactatattttgtattttgttactatagtttgcatttaaacagaaagatgatcttgccagggaaagcatatccccttttagtccctaactgctgctataaattcaattaatttcataatatttaccatcccctttactactttggcagggtagtccttaaaagtttgttctatccaaactcttacataaaaactgacttccaaagatgtttaacattcttccagttactcattggtacgcactcagttttatacaattcctctataactatatgacaaatctctgcattaatggaacaagagcagttaattgaccttttcagtggggaatgagttgcacttagcttttcatatatacaagagtagtatttaaattgca

SEQ ID NO: 6 - DNA, 801 bp, Homo sapiens
  misc_feature (401)..(401): Y = C/T
ccaccaaacaatggctaatgcatttgagaggggaaaaaaatcccagtagatctgttaattgggaatcactgtgctacaaatgcttgaagtataagcaaacattttcctatgatgagttcataagctttttaatgaaatattcggaagaatttaacccattccctgtttttcttaagatgtgaaaggaagattttagaaagacttacgtaaactttaagtagactttaaaagtttgttgtgttagagaaatatttgaggagatgttataatgcaatagaaatttttgctttatattttttaaaggattttttatggtattttgtttgtttttcagagtaaagccaatcccagctgaaggaatcaagtcaaatccttccaagcggcatagagaccgacttaayacagagttggaccgtttggctagcctgctgcctttcccacaagatgttattaataagttggacaaactttcagttcttaggctcagcgtcagttacctgagagccaagagcttctttgatggtaagacagaagggtttaatttgtctacaataacgtataaaaaatacttgtactagatatagctgtttctgtgttaataactacaaaaattagccgtatttggaaaatttattgctgtatagtaaaatttcagtggcaaagccagatttataagtcttaaaatcaattttccagttttattcacccaacagatgcagccactgaaatgatgcatggtatcattctttgaaaatcatatatttagaagttacactcaaattgattatgtcaaattccagt

SEQ ID NO: 7 - DNA, 601 bp, Homo sapiens
  misc_feature (301)..(301): R = A/G
gttccctcctggctgccatgatgcaacaagatgagtctatttatctctatcctgcttcaagtacttcaagtactgcaccttttgaaaacaactttttcaacgaatctatgaatgaatgcagaaattggcaagataatactgcaccgatgggaaatgatactatcctgaaacatgagcaaattgaccagcctcaggatgtgaactcatttgctggaggtcacccagggctctttcaagatagtaaaaacagtgacttgtacagcataatgaaaaacctaggcattgattttgaagacatcaracacatgcagaatgaaaaatttttcagaaatgatttttctggtgaggttgacttcagagacattgacttaacggatgaaatcctgacgtatgtccaagattctttaagtaagtctcccttcataccttcagattatcaacagcaacagtccttggctctgaactcaagctgtatggtacaggaacacctacatctagaacagcaacagcaacatcaccaaaagcaagtagtagtggagccacagcaacagctgtgtcagaagatgaagcacatgcaagttaatggcatgtttgaaaattg

SEQ ID NO: 8 - DNA, 801 bp, Homo sapiens
  misc_feature (401)..(401): M = A/C
ttctaattacctctctgcattcccacattagaaaggagaaaagcactgatatgtttgatatgatataaatgtttaatatcagactcctgctcacaattttctgaaagttactaaaacttctggggctagaaatcaaataacatttgtgccatttaaaaatgtaaaacaaaccaacataaatgtcatcagaagaataaaccttactaatatataagaacatcatcatttgagacaagtattgcaaaaattaaaaagatgatttgtgagcctgattaaattattttactgtaaaaggctacactggaagaatgtacgataatagccaatctaataataaacaatattacatacactgtatgttttacatgctaagagagacttactgaaacataatgtacatmcaataaaataaaagtgaaaaagtctcacttacttggcatcacaaccaataggtgtgaagtctagtttgtgtttggttctaaagataaaatttttggtccggatttcaagtatggatggtggctgaagtggagtagctatcgcaaacaaagccaactgaggtggaagtattgatccatctttccctttctttttctgtccatgaagatactttaacttcccttggaaattcattgccttaaaaaagcaacaacaacaaaaaagttcattaaaattaacaatataaaatagtgcctttttaaaaggctccattatggctgcctctagggttcttgataattccataaatattcctgaagctgagaactgttagtttccttcactcctctctccatgggacgc

SEQ ID NO: 9 - DNA, 632 bp, Homo sapiens
  misc_feature (212)..(212): R = A/G
attaagacagttatataatacattaggcttcaaacaggcttttctatggacattaatgtattttctttagaatgcaagaaatcaggagtttagactttgtggtagcagtagtagctagataccactactttagtcatctacacttaaatcttcctaggaacctaatcttctagtattaaatcatcttgatgccaaccattacacaatttccraaagttgcatctgaaacacaagttgaaatatacacaccccctgtaacaaaacccttcagtggtttccactgggtatataatatagttgaagctctagtctatataactgttattaagaccagcagccttgtgagcttaatagaaatgcaaattcatgggccccactgtgaactactgattcagaatatctgacaatggggctcacagggatgaccaagttttatcaaggtcttcaggtgattcttgtgcacagtacaatttgagaaccagatatatgagaatagcaagcattcaaatgttacaatctgttctcaaaccataaaagatgttcttgcccttccaatatatcaaatatttataattccatctattcactgttcattcaataacatcaaacaagtcagacacgtctgtttcctt

SEQ ID NO: 10 - DNA, 601 bp, Homo sapiens
  misc_feature (301)..(301): Y = C/T
tgaagatatacagaacaattaaaaatagagtaatcttacattaactgcacttgacttggattacgctaatatttttacttttgtattgtcttcgaatctttaagaaaggacactgctaaccattatttaaggaaaagcctgtttgaaatataaataaacatccctgtaagattggatttgggagctctggagttcaaacatctcctgaaatagaccgtatgatgttggtcaggcaaaggagtaacttattattttttgaaacctttacctcaaaaatcttgtcccaatctgtaaaattgtyatgaaatcaagactccagctgactgcatgccatgcttctgtttagaagccctgcaagctttaactgctggtggtaacaggcccaacagtatgcccaatgccagtctgaatgctatcttgaaagcctttttaacatctccatcaaaaaagtctatgaggttcatcatttgtagccagtgtttgaagcaaagctgaaaaaattaaccaagtttactcataaatataactgttttatataatattcattataaaacctcaaaatgacatgcaaagatatggtttcagtaatcctatgagatca

SEQ ID NO: 11 - DNA, 601 bp, Homo sapiens
  misc_feature (301)..(301): Y = C/T
gcgccaccgtgagcgacccaggccaggattctaaatagacggcccaggctcctcctccgcccgggccgcctcacctgcgggcattgccgcgccgcctccgccggtgtagacggcacctgcgccgccttgctcgcgggtctccgcccctcgcccaccctcactgcgccaggcccaggcagctcacctgtactggcgcgggctgcggaagcctgcgtgagccgaggcgttgaggcgcggcgcccacgccactgtcccgagaggacgcaggtggagcgggcgcggcttcgcggaacccggcgcyggccgccgcagtggtcccagcctacaccgggttccggggacccggccgccagtgccyggggagtagccgccgccgtcggctgggcaccatgaacagcagcagcgccaacatcacctacgccagtcgcaagcggcggaagccggtgcagaaaacgtgagtgtcccgagcgcgtcctcatcgcgggggctgggcgctcaggcacgcgggtgcgggaggcagccccaccccgcccccaaatccctgcgatcctgggattaggtccattcccggcactgccmgtggaatcgaggtttggaggcc

SEQ ID NO: 12 - DNA, 601 bp, Homo sapiens
  misc_feature (301)..(301): N = A/C/G/T
agaggtatataaccacaatacctctatcacctgtaaaatcccgattccaggacacaacatagataaattaaataaaaatttttgtagtggagccaaggatccgtaatttttacagttctcaagtgactacaatatgcaacaaatgttgagaaccactgtccacacattaattaaatttgttaaatattttcagtaaagaatacattttgtttcttaatatgaataagaatgatagccttttaaagtttagcaaatctaaattatatattttaggtcagcattttacaataatttacatttnccttaagctgttcttatcaagttaataattttctttgttaaataaatgtattttatcttaatttcagtttcttctatatcatgatttaaaatgcagaaagtatgtattatgtagttttcaaatatatttatctccaaagttaaatggattttagtaaaaatgatatttatacatatatattttaataaaatgtttaataaattagacatgaatcttagcatgtgaaacataaaacttttttataactttccccataatcaaacttcaaattcgtaagaattaaaagtccggaaagaaaga

SEQ ID NO: 13 - DNA, 461 bp, Homo sapiens
  misc_feature (208)..(208): R = A/G
gcaccgatgggaaatgatactatcctgaaacatgagcaaattgaccagcctcaggatgtgaactcatttgctggaggtcacccagggctctttcaagatagtaaaaacagtgacttgtacagcataatgaaaaacctaggcattgattttgaagacatcaracacatgcagaatgaaaaatttttcagaaatgatttttctggtgagrttgacttcagagacattgacttaacggatgaaatcctgacgtatgtccaagattctttaagtaagtctcccttcataccttcagattatcaacagcaacagtccttggctctgaactcaagctgtatggtacaggaacacctacatctagaacagcaacagcaacatcaccaaaagcaagtagtagtggagccacagcaacagctgtgtcagaagatgaagcacatgcaagttaatggcatgtttgaaaattg

SEQ ID NO: 14 - DNA, 601 bp, Homo sapiens
  misc_feature (301)..(301): S = C/G
caaaacatttcctgttgtgaggtggttgtattcatgtgtttattccaatttttttatttctagatctctgagttactttacctacatgtgtttcaagttttcgtaaacaattttaagaactcttaaacgtcttctcagaccaaatcagaagtgtgcattttgcttagactccaactatcactaatgggaaccagaaaaataacactttaagatttacatttaaaaccagttattggtttaaagtttcattctaaaattttagtttcctttcagaatttcagttatcatagttcttcagaastatacttatgaattggcattaacagaggataataatctataaatagactgatgaaaatttggaagttttatggtacagtgtgtcttaagggaatattgtcaaaccagcagttttctaccttggcagtttgagacatcggttattaatacttttaattttgtagaatggtttcttatattaaagtatgtttgtcttatttgacattgtcattgatggttaaagttgggaggcatcccaaatgtctgttctatgtgtttattaatataataatacacttagcatcatatataataggggtgt

SEQ ID NO: 15 - DNA, 601 bp, Homo sapiens
  misc_feature (301)..(301): R = A/G
ggggccctcaaggaagayggaatggaatccagatgggcgggggcaagcaggacggggcggggctacgcgggatctgggcggggcggggccggtgaggggtcgggggtgctcctgctattcagccggtgcgcgcggcggcgggaggcagtggctsgggagtcccgtcgacgctctgttccgagagcgtgccccggaccgccagctcagaacaggggcagccgtgtagccgaacggaagctgggagcagccgggactggtggcccgcgcccgagctccgcaggcgggaagcaccctgratttrggaagtcccgggagcagcgcggcggcacctccctcacccaaggggccgcggcgacggtcacggggcgcggcgccaccgtgagcgacccaggccaggattctaaatagacggcccaggctcctcctccgcccgggccgcctcacctgcgggcattgccgcgccgcctccgccggtgtagacggcacctgcgccgccttgctcgcgggtctccgcccctcgcccaccctcactgcgccaggcccaggcagctcacctgtactggcgcgggctgcggaagcctgcgtgagccgaggcgttgag

SEQ ID NO: 16 - DNA, 501 bp, Homo sapiens
  misc_feature (251)..(251): R = A/G
ttgtattttgactattttaggatttttaaggtatgagagaattatgtagcccttttttaataggaggatgcttaccatcttgggattgaatgcctgctagacagagaaattatggcctttccatatgtctcaaataactgccacatagaaaaacgattgtatattcatgattgtggaatcatcatttgataggagatgctgttttcttgttacaaagtctgaacacctgcataggagttgactgtagggarcagcttaggattcctcagagtggacttgtctgttatctcattgtatccttagctcatgttaccaagtacaggagaagaaaatacaaagtatattgtatattctttttgtgaataacaaggaatttgaaacagataatcaaatcttaaattaacattaccaagcaatgatttttgtttatgtgtttatttctgaagaggattttgctgacccagaattagaattatgctttgagacagttttcccagtgtt

SEQ ID NO: 17 - DNA, 801 bp, Homo sapiens
  misc_feature (401)..(401): W = A/T
tatacataaattatggtttttttaatatcgttaaaacactttttcatatttttaaagctttataaaattactaaaaaagaacgttaaacaaaaagaatgctactgtctgtgaaccatatgggaaacaccctttgcaaatcttgtttttccttcttctaaatagggaatggtataagcaacagactcttcccataggtactagatttcattgaagctaaatagtcctaccatctccatcttcctacatccaggacaactccctaagcatccccaagtttatatatattaaatgcaatacatgtttgttttgccattccagtcaccaagaatgctactgtggcttcctcctctgaaaacaccactcaccttcaaatctctgagtaagatcttgctcaatctcwtcgaatcctgctgctcggacattgctgaagaagtctttcaagtaatccagagcatctttcattcgtgcatgctcactgataatgagggcatcattatatttctgttgaaagtaaaaactgtctcaatatgcttccaatgtctaacacattcactgtatttaagttcaattcgttgtatttaacgaattgttttaagaaaacttttcttttcaaatctattccaacttagctttttaaagatgaatggcctctaacagttatgtaacaaaatctttgaaccaaatactgttaaaagaaaactcaattagctagtaacattaattatcatcactttggattattgaattttaccttagaaaagaaaaactgcacgaaaaacacatatcaaaatttaaaaata

SEQ ID NO: 18 - DNA, 601 bp, Homo sapiens
  misc_feature (301)..(301): M = A/C
attctatggacatctttagtgcttttatgagcatttttgatgaagaaattgaaagactaattggaggccacaattaagcattgactaatactaagttaggagaaccaataaaatctgtgattttacaaagtcaggtaccatatgttcatggaagttgtatatgaatgattatacatgtgcgtgcatgtatatgtattgtacgtatctgtgcctgtttcttgctatatatgttgtactcaaattacatttgcggtctttctttttgcattagattctgcatatacagactcatgaaaaattmatcagagatagtcaagaaaaaccaaaacctgtccctgataaggaaaataaaaaactgctctgcagaaagtgcaaagccttggcatgttacacagctgacgtaagagtgatagaggtaagctgcctttttacaaagtgcctggtcatgttttagcactagctacagcttactgttggtgaaatatttataataaaactactattatttccattgttactgtggccatgatctgtgtatttaaaaaaagctaagaagtgaaaaaaaaatactaaatgttcaataataaagaaatagtttttg

SEQ ID NO: 19 - DNA, 601 bp, Homo sapiens
  misc_feature (301)..(301): R = A/G
gtgactgttactcaagttcaaggttaaatattttctactaaacagagagagggtcaaagttcagtattcgtctagatggctctgaactagaggtagtagagagtaacagaatctcaaaggcttgttattggatccaacttacacttctggggcttataaacaacttgctccagttcctccagattgtgtttgactgttgctatcactgacgcatcaagagaagcacacagcttgcagatataatccaaggcttcatctgtgtttttggcatccccaacaccaaccgaggcagtcagcccartgacctgtaaggagcattcaaaatcattagatgtctgagaaatggtacaatgtttccacaacccctcatataactctttcctgctggggtagggcgtttttttgtttttactaacacacagtgtatggcacatggaggcacataatgcatatttactaagtgaacaaatgaataaaggaaacaaaattcataatgagttgtacaatatggacttgggacctgagaaggacatcttcagtgtggccataagagtaagaaaataggagttaggaagattatagctcttctgaagcattcgtc

SEQ ID NO: 20 - DNA, 601 bp, Homo sapiens
  misc_feature (301)..(301): K = G/T
gtagcatgccaacagccaggacccaaaagcaagctaaaagaggacacttttctttaccttctcatgaaaggtaaagaaaatacattaaatacattaatgtacataattaattaattacataatcccataaaaaacattaggattatattaggacagttttctcaaaagacacatggaacaaggaaaaaactgaaacttgcccattctgtcccagtattcaacaaaagaaaaaaaaggaagcaaacagaaaaactatgtaagtaatggcaataggcttacctgtaggagcacatattattgkgttttttcctttcatagcaggcaaagcaagctctaattggtaatttcttggtttaaatgggctgtacaagtttgtatcagacacttctggaatacaaaaggagcaaaattaccaaacagttcctgctctgaggaatcacggcaatagctacagtctaatgtccacaaattctgactccagcaagaagatcctcattggagaaagtttagaatcctttctcttggtaaccattctagcttttccactaatttgaagtacagaattctctcagtgacaaagtattgatggcaagaaagaaaa

SEQ ID NO: 21 - DNA, 401 bp, Homo sapiens
  misc_feature (201)..(201): M = A/C
caaactaattttgtaggcaagtaactgcctccctcccagaatccagcttcctgctggtctcgcgttagagatgtagctctggctatctgaggggaaaaacgcctctgatgggatgtaaaagaccggttggaatgagcgagtcctaagtagagctgtgaggagggtacagtgtcttacctttctctacaatccacagttcamtgaacttgttcctttctttctccaaagcaagtttcaaagttttgggccagttttccttgtctgatctgagaaggcattccaccaatttctctgcacctgccatcatccccttagtagagcaaatctaagcaaggtaactgtagtttattgatcaattatctcaaaagttttccctttatcaatttttactgaagaaatgt

SEQ ID NO: 22 - DNA, 801 bp, Homo sapiens
  misc_feature (401)..(401): R = A/G
cccagccaagcacacagtagactttaatattagtgaaaataaatgaaacaaaatttcttccccagctttgaacctaaatagatgagcacccttaagcaagtcacttcacctcgctggaactcagtttccccacctaggcctccgagggctcctcaaactctggcaacctctagcctaaaatgctgcggagatcttaccacaaacctggggagtctggcaggctctctgcattgattaaaagaagggaacgaagcaagagaaaaacaagtcctcaattgttttccgccgagaaggcgccgctggagacactcaccctccctaaaccagggggccatgtagctcaggatgtaggtagggtccagggtcttccggatataatcctggaaggcttgcaggctgcrtcgctgctcggtggtcatgccggcctctgcttgcagctagctacgttccccgcaggctgtgcctcactagctttaaagccgggtaggaggagggcgtggcgagcggggaaagcagggattttccgaggaaatgaggccggacgcgaggcggagctgcataggaactttaataactaaagggaaaatcgaaagtgcaactagcggcgggcggggttcgcggaggctgttttgcctcgggctagtttcgtttccctccgcaccgaggaagcccgggaacggagaggacccctaggaattgcttttatttttatgatcttatattttgttttgcttttatagcgctaacgtttagacacagtaaaatgcacacaatctgagtgtgcaattcgatgagttttgt

SEQ ID NO: 23 - DNA, 101 bp, Homo sapiens
  misc_feature (51)..(51): Y = C/T
gagagagagagtgtgtgtaaaggaggaattgtcaaacacttataaaaccaycagatctcatgagaactaactcactatcccaagaacagcatggggacaac

SEQ ID NO: 24 - DNA, 902 bp, Homo sapiens
  misc_feature (501)..(501): R = A/G
tacccagctatgtgggaggctgaggcaggagaatcacttgaacctagaaggcagaggttgcagtgagccgagatcacaccactacactccaacctgggcaacagagtgagactccatctcagaaaaaaaaataataataataacttttatcttattaaatctatttctagtagatgttttacacatcctattggagttcttaaacaatagtgtattagtctgttttcacactgctataaagaactgcctgagactgggtcatttataaagaaaagaggcttaatagattcacagttccacatggctgaggaggcctcaggaaacttacaatcatggcagaaggggaagcaggcaagtcttacatggcagcagatgagagagagagtgtgtgtaaaggaggaattgtcaaacacttataaaaccatcagatctcatgagaactaactcactatcccaagaacagcatggggacaactgcccccgtgatccaatcacctcccrtcaggtccctcccttgacacatggggattataattcaagatgagatttgggtggggacatatagccaaaccatatcaaatagcaattaaaaaaaatcacataagaaaagacactcttaataaaatacaaatagaaaatgaaaaaaaaccaactcataaacttggtttaaataatccatttgtattgggtcttagtaagaatactactactagtaactattatcaagcaactactgtgtcatgtacttttcacacattcttttaattaaaaactctccactaacccttacagttcagtattatccttgttttacagatgaagaaaagccaaagagaagttatataactggcaagtttctctggctccccgcctgcaccactgctcaccagattgcatgaaga

SEQ ID NO: 25 - DNA, 801 bp, Homo sapiens
  misc_feature (401)..(401): N = A/C/G/T
aaaaattcccaacattccattcattcatctatcccagtgtgtacagagtgattactgtgtgtttgttggcagttgactctaaaaagaaggctagaaatgaggctttttaatttttcccaagtactatgagctctgttggcctacaaaatactcagtgctgtgattcactcatttgtgctttgcatatataatatagtacaaactgctaaagatatttttaaaaaatatattttcacaggggtacaagcgatccatgattatacccactatgtttgtttcttctccactcaaagttactcattccctgtagctgaagattgaggacctgatatcatttggacatttctgctggatcaaatggtatcttctcaaaatgaaagtccttccacttcgagtacagngtctgaactccagttgcaatatcctccaccacaaaactttcaatttttataactggaatctcaaatgtcttgtacttcacatggattccccagtcatggctgcagttctgtcgggcacagaatatctttgctcttttttcaaaacttgaaaactgctttggcttgggatgtggtctactcacaaagcattccttaaaagcatctccaagcacagtgtaatggcattcctacagatgaagggatggaataacacacaaaagagaacgttagaaccagtacataattgtgatttaaaaaaaaaaaaaagaaaaccccacaataatctgaggcaaagaacaggtgggtctcacttattttacaattggaggaaaaaaaaaaatagattcacccaaagtccaga

SEQ ID NO: 26 - DNA, 601 bp, Homo sapiens
  misc_feature (301)..(301): N = A/C/G/T
gcaggcaagtcttacatggcagcagatgagagagagagtgtgtgtaaaggaggaattgtcaaacacttataaaaccatcagatctcatgagaactaactcactatcccaagaacagcatggggacaactgcccccgtgatccaatcacctcccgtcaggtccctcccttgacacatggggattataattcaagatgagatttgggtggggacatatagccaaaccatatcaaatagcaattaaaaaaaatcacataagaaaagacactcttaataaaatacaaatagaaaatgaaaaaaanccaactcataaacttggtttaaataatccatttgtattgggtcttagtaagaatactactactagtaactattatcaagcaactactgtgtcatgtacttttcacacattcttttaattaaaaactctccactaacccttacagttcagtattatccttgttttacagatgaagaaaagccaaagagaagttatataactggcaagtttctctggctccccgcctgcaccactgctcaccagattgcatgaagagggaggcagctgtaacacctcatcccgttgatctccagggaactca

SEQ ID NO: 27 - DNA, 801 bp, Homo sapiens
  misc_feature (401)..(401): R = A/G
tacacattgctacatacagcaactctacagtggacagcttttagtagtaagcataaaaatggctttatgttctcatgttctctgtgtagccataccacacgttgctacaccaggaacatgagtacatataaccattacatatacatacctgtatgtatgtatattagttacatatacatatgtacagtatatacatgtatatatattgaacccttggaagggatcagcaaagaggaggactcaataaaaaaagactagaatagaactagaagagagagaagcccagggagagcttcaagaagagtgctcaacagggccaaatgcgcagaggtcaaatagaaggttaagaagtgcccagtggatttggcaaccagagtcactggtaaccttcaaaagaacartttcagtagattgttaagggcaaaagccagtttacagtaggttaaggagacaaagggagataaaaattcccaacattccattcattcatctatcccagtgtgtacagagtgattactgtgtgtttgttggcagttgactctaaaaagaaggctagaaatgaggctttttaatttttcccaagtactatgagctctgttggcctacaaaatactcagtgctgtgattcactcatttgtgctttgcatatataatatagtacaaactgctaaagatatttttaaaaaatatattttcacaggggtacaagcgatccatgattatacccactatgtttgtttcttctccactcaaagttactcattccctgtagctgaagattgaggacctgatatcatttgg

SEQ ID NO: 28 - DNA, 701 bp, Homo sapiens
  misc_feature (201)..(201): W = A/T
gatataatcctggaaggcttgcaggctgcgtcgctgctcggtggtcatgccggcctctgcttgcagctagctacgttccccgcaggctgtgcctcactagctttaaagccgggtaggaggagggcgtggcgagcggggaaagcagggattttccgaggaaatgaggccggacgcgaggcggagctgcataggaactttaawaactaaagggaaaatcgaaagtgcaactagcggcgggcggggttcgcggaggctgttttgcctcgggctagtttcgtttccctccgcaccgaggaagcccgggaacggagaggacccctaggaattgcttttatttttatgatcttatattttgttttgcttttatagcgctaacgtttagacacagtaaaatgcacacaatctgagtgtgcaattcgatgagttttgtaaagtgtacacctgtgtacccagttctcccacgtcggctgggtgccagggtaagtctatgtttagctttataggaaaccgccacctgttgtccaaaatgactgattacatccagtttacattcccacccgcagtaggagagctccagtagatagacacattggtcagcctttcttttttttttttaattttaacttccatcttggtcggtgtgaaatggtatattattgtggttttaattttaatttcccatataattaatggtgggcaca

SEQ ID NO: 29 - DNA, 693 bp, Homo sapiens
  misc_feature (201)..(201): N = A/C/G/T
cgtgccctttgactcctgggaccagctcatgaggcagctggacctcacgaaaaatgagatcgatgtggtcagagctggtacagcaggcccaggggatgccttgtatgcaatgctgatgaaatgggtcaacaaaactggacggaacgcctcgatccacaccctgctggatgccttggagaggatggaagagagacatgcaanagagaagattcaggacctcttggtggactctggaaagttcatctacttagaagatggcacaggctctgccgtgtccttggagtgaaagactctttttaccagaggtttcctcttaggtgttaggagttaatacatattaggttttttttttttttaacatgtatacaaagtaaattcttagccaggtgtagtggctcatgcctgtaatcccagcactttgggaggctgaggcgggtggatcacttgaggtcagaagttcaagaccagcctgaccaacatcgtgaaatgccgtctttacaaaaaaatacaaaaattaactggatgtgatggtgtgtgcatatattctcggctactcgggaggctgaggcaggagaatcacttgaacccacgaggcagtgagctgagattgcaccactgcactccagcctgggacacagagcaagactctgtctcaagataaaataaaataaacttgaaagaattattgcccga

SEQ ID NO: 30 - DNA, 601 bp, Homo sapiens
  misc_feature (301)..(301): K = G/T
gcagacatttggaagagtgcctgtccccttgtgagggtggctgctttttcccacgcagccccgtcccctgcagtcccatctccctcaggctccacttcccctttgaccaggagagccgaggcatggccttcaccccctgcctacaaggtcttggaggggcctgtccccaactcaccagcagacactgtgcctcccctggggactgtacagtgacacctgtcaaatctgccggctcctggctttccatttgctgctcagagacgaaagtggacagcgagtctgcgttgctcagaatctcgtkgtgagcattgtcctcagccccaggccctcgtaggagacccaagcgccagaaacacaccttaggaaggcaaagagccaactcagaagcccacacccagggctccccacggggtccgtagggcacggctggacctgctgccaccaccccctcccagtgaggtcactccaggaagtccatgctcagcacatccaggacctgctgctggggccaggccctggtgctgggcttgggggctcaccccatccccagggtacaggctgtggggtaagggtctcacctgggctgtaggaagcacagggc

SEQ ID NO: 31 - DNA, 601 bp, Homo sapiens
  misc_feature (301)..(301): M = A/C
cacagaaggctcctggaactgcagctctgaccccagagcagggaggccaagggggtaaagtgtgcatgctcagacccttccccagcctaaacaagggagcatagggggaccccctgcagatacgaggagactatccttcccctgacgccttctcagggacattgggcagggagagtggctcctctttcatcccacctggccagctttccatcaagagtcccccccctccctccctgtgtgtacccaggtgccccagagggatggtcaaggtcaaggattgtacgccctggagtgacatcgmgtgtgtccacaaagaatcaggtacaaagcccactggggaagccccagctgcagaggagacagggaccagcagcccgagactcctgtcttttcctgtcttttctcaggcaatggacataatatatgggtgattttggttgtgactttggttgttccgttgctgttggtggctgtgctgattgtctgttgttgcatcggctcaggtaggtgctggctgagggcaagggctctgggcactctctgccctgccttcttctgttcccacagacagaaacgctcacccctgccccaagtcctagtg

SEQ ID NO: 32 - DNA, 601 bp, Homo sapiens
  misc_feature (301)..(301): S = C/G
tccaagtgttggtgacagctgaagggtgggtgtcctgtgtgagcccgagtgtgctggtgcagaatctggccctcagaactccttggcaaactgagttgagctgagctgagggggagggagttggggtggtgaggaaaggtcaagggacacgtcagggaaacacattcccaaaaccttgtactctgtcatcagatgaagaagagagaagtccctgcaccacgaccaggaacacagcatgtcagtgcaaaccaggaactttccggaatgacaattctgctgagatgtgccggaagtgcagcasagggtgagacaacagccaaggggctcccagcagcctcaaagaaaccacagaagcaagaaccctaaaaagacccgagtctccttgtacccgtatctatcagccctgaccccatggtgcctccacccccataggtgtccctgagcctgtggcgtctcctgagcctgcaacctgcccctcctggtccatctgcctgtccccacccctgtcccctgcagtggccccttctcacccctccccagcactagtccccttggccaggctgacttgttcactaggcacaggaggccatgacttagggcc

SEQ ID NO: 33 - DNA, 701 bp, Homo sapiens
  misc_feature (201)..(201): S = C/G
gaagaacatggaaaaggaatgttattgatgaattttgagataatttttgtatatagtatagggtaaggaaaagagaggtgtaaaggattagagatcagtcttagaatgtacctggtggacacaactctcccaaagggctatgttcccattgctgtgtgccaattgattgatcatgaagtttgatggttgcagctgagctasgtacgacctgtggggacaaagcagggactggcatgagtggcttccagatctcacccattacaagatcaatctcacattccattcccccaagcctccaaaattagacagaacttgcatctttctcccagttctaaaactcaaccatttgtttgtgctcatctttgtctctttgtccccatgcccccagcctgtggcaactaccattctactgtctgtttctatgaatttaactactctacatacttcatataaatggagacatacagtattttatggttttcttgaggctgtcatatttcaattagcataaaatcatcacgatccatccattcggtaccatgcattggaatttcattcctttccattgtgtgtatatgtattacgtttatccattcatctgtcaatgggcacttggtttgtgttcacattttagctattgtgaataaagctgctatgaacacgggtgtacaaaatctctttatgccctttctttcaattct

SEQ ID NO: 34 - DNA, 501 bp, Homo sapiens
  misc_feature (251)..(251): Y = C/T
aagggcggtcacagaggaaggaagttcagggttagccaacaggagccgcaggtgccccgaaaagggggcggggtcaggggtgccctgaactccgaatgcgaagttctgtcttgtcatagccaagcacgctgcttcttggattgacctggcaggatggcgccaccaccagctagagtacatctaggtgcgttcctggcagtgactccgaatcccgggagcgcagcgagtgggacagaggcagccgcggccayacccagcaaagtgtggggctcttccgcggggaggattgaaccacgaggcgggggccgaggagcgctccctacctccatgggacagcacggacccagtgcccgggcccgggcagggcgcgccccaggacccaggccggcgcgggaagccagccctcggctccgggtccacaagaccttcaagtttgtcgtcgtcggggtcctgctgcaggtgagtccccaccgcggtcctgcctggggaaaagcgcgcctg

SEQ ID NO: 35 - DNA, 441 bp, Homo sapiens
  misc_feature (210)..(210): K = G/T
ttgaggaacagaagctgagagcggcaagggcggtcacagaggaaggaagttcagggttagccaacaggagccgcaggtgccccgaaaagggggcggggtcaggggtgccctgaactccgaatgcgaagttctgtcttgtcayagccaagcacgctgcttcttggattgacctggcaggatggcgccaccaccagctagagtacatctagktgcgttcctggcagtgactccgaatcccgggagcgcagcgagtgggacagaggcagccgcggccayacccagcaaagtgtggggctcttccgcggggaggattgaaccacgaggcgggggccgaggagcgctccctacctccatgggacagcacggacccagtgcccgggcccgggcagggcgcgccccaggacccaggccggcgcgggaagccagccctcggctccgggt

SEQ ID NO: 36 - DNA, 601 bp, Homo sapiens
  misc_feature (301)..(301): N = A/C/G/T
tgctctgtgtcccaggctggagtgcagtggtgcaatctcagctcactgcctcgtgggttcaagtgattctcctgcctcagcctcccgagtagccgagaatatatgcacacaccatcacatccagttaatttttgtatttttttgtaaagacggcatttcacgatgttggtcaggctggtcttgaacttctgacctcaagtgatccacccgcctcagcctcccaaagtgctgggattacaggcatgagccactacacctggctaagaatttactttgtatacatgttaaaaaaaaaaaaaancctaatatgtattaactcctaacacctaagaggaaacctctggtaaaaagagtctttcactccaaggacacggcagagcctgtgccatcttctaagtagatgaactttccagagtccaccaagaggtcctgaatcttctcttttgcatgtctctcttccatcctctccaaggcatccagcagggtgtggatcgaggcgttccgtccagttttgttgacccatttcatcagcattgcatacaaggcatcccctgggcctgctgtaccagctctgaccacatcgatctcatttttcgtgagg

SEQ ID NO: 37 - DNA, 601 bp, Homo sapiens
  misc_feature (301)..(301): Y = C/T
gcccaggtgagacccttaccccacagcctgtaccctggggatggggtgagcccccaagcccagcaccagggcctggccccagcagcaggtcctggatgtgctgagcatggacttcctggagtgacctcactgggagggggtggtggcagcaggtccagccgtgccctacggaccccgtggggagccctgggtgtgggcttctgagttggctctttgccttcctaaggtgtgtttctggcgcttgggtctcctacgagggcctggggctgaggacaatgctcacaacgagattctgagcaaygcagactcgctgtccactttcgtctctgagcagcaaatggaaagccaggagccggcagatttgacaggtgtcactgtacagtccccaggggaggcacagtgtctgctggtgagttggggacaggcccctccaagaccttgtaggcagggggtgaaggccatgcctcggctctcctggtcaaaggggaagtggagcctgagggagatgggactgcaggggacggggctgcgtgggaaaaagcagccaccctcacaaggggacaggcactcttccaaatgtctgcttcttagtccctgtcct

SEQ ID NO: 38 - DNA, 465 bp, Homo sapiens
  misc_feature (201)..(201): Y = C/T
cgctgggaccaagtggcaaaacgactccgaatgcagcggcatccacgcggcggccgtggttgaggaacagaagctgagagcggcaagggcggtcacagaggaaggaagttcagggttagccaacaggagccgcaggtgccccgaaaagggggcggggtcaggggtgccctgaactccgaatgcgaagttctgtcttgtcayagccaagcacgctgcttcttggattgacctggcaggatggcgccaccaccagctagagtacatctagktgcgttcctggcagtgactccgaatcccgggagcgcagcgagtgggacagaggcagccgcggccayacccagcaaagtgtggggctcttccgcggggaggattgaaccacgaggcgggggccgaggagcgctccctacctccatgggacagcacggacccagtgcccgggcccgggcagggcgcgccccaggaccc

SEQ ID NO: 39 - DNA, 511 bp, Homo sapiens
  misc_feature (256)..(256): R = A/G
gtagacacaaggctttgggattcccttcagagaaggagcaatgcatctccatcactcgtgtggtaagtaaaattgctgctcagaacacttccatgcctgctcctttgtgattcagatgaggagaaatcaacgtggactgagcgcccacacaggacagccaggcatttcccatacaggtggtaaaggtatcttctgaacttctccccagcaaatgcatagatgagaggattcaggcaacaatggctaaatgcaaccrtctcagtcacactgagggccagcctcagatccttcctcatgtcacaactgggaaagaagtcatagagcttaagcgtctccaggaaaatcataacgttgtagggtgtccagaagaggaaaaacacgatgaccaccagaaggatcagtttaatggctttggctttcttgtggttcttgcaggaaaacagcgtctggatgattctgaagtagcaataactcataatgagcagggggagtaggaagccaagaaaatttg

SEQ ID NO: 40 - DNA, 601 bp, Homo sapiens
  misc_feature (284)..(284): n is a, c, g, or t
  misc_feature (301)..(301): Y = C/T
agggtgtccagaagaggaaaaacacgatgaccaccagaaggatcagtttaatggctttggctttcttgtggttcttgcaggaaaacagcgtctggatgattctgaagtagcaataactcataatgagcagggggagtaggaagccaagaaaatttgtttccacattgcggagcacgggccagatttcctggaggacctcggggtagtcaccaaggcattcattttctttctgctttgtgaacatgaactggggtgctgccaccaaaatggctgctgcccagacncctaggctgatggtgaygccatgctgcacggtccggttgttcatggagttggcggccaggacgatggccaggtacctatcaatgctgatgacggtgatgaagaatatgcttccaaaaaagccgatgaagaagaaggcggtagtgaatttgcacatggcattgtggaggcccttttcatttatcaaatagtgagtccagaagggcaaagtggctacaaacagcagatcagacaaggccaggttcaggaggtaaatgtcggtgacactcttgggcttcttgctgttggtgagggcaaacactaccaacaaatttcccac

SEQ ID NO: 41 - DNA, 601 bp, Homo sapiens
  misc_feature (301)..(301): K = G/T
tcacagagccatttactgcatggctttgggcaagtcaaaggagtccgcctctcctgtcagaagagtctgttgcagtcttcatcacaagactgttgtggggattaaacaagatggcaagtgggaagttgggaaatgtagtgtgcacccaaccaatatttgtttcttcctgcctgcctacatatgaggccacacagaattccaactttgtttctctgataactaacacagttacttgtttttctttctgatccaggccttcaccatggatcagttccctgaatcagtgacagaaaactttgaktacgatgatttggctgaggcctgttatattggggacatcgtggtctttgggactgtgttcctgtccatattctactccgtcatctttgccattggcctggtgggaaatttgttggtagtgtttgccctcaccaacagcaagaagcccaagagtgtcaccgacatttacctcctgaacctggccttgtctgatctgctgtttgtagccactttgcccttctggactcactatttgataaatgaaaagggcctccacaatgccatgtgcaaattcactaccgccttcttcttcatcggcttt

SEQ ID NO: 42 - DNA, 601 bp, Homo sapiens
  misc_feature (301)..(301): M = A/C
tgcctcagccccttccttgcctctgactcccctcctcttctgagggctcctttcttggatctggccaagactctccctctcttcctgtcccacactcttgacgacagtctcatccaccccacatcagtaatcccctccgtgttcatgagcacacatctctacctccatccagggcctggataatttcccaagcccatctaaccttctccgttctctgtctttcctctcaccacttaccccactggccattctccacccagaagccagagagctcttcctgaaatccaagtctgccaacttmaacgcctccaggggttctctcatcctggtttaagtccacggcctggtaagcacggcccgccccttctcacttcctactgtgctctcaccacttccacttcccccaacatgcctgtgcccgtggcaggctctcttcccttcccaactcacctggctgtcctgtccaggacgtgattttaccctcttttaaagctaacggctatgttccacagctgctagcagcacagggcttcatgcttggcaagcatgagaaccagcgtccagtgtcagttgccttgcccccaagccccacagagtgatg

SEQ ID NO: 43 - DNA, 601 bp, Homo sapiens
  misc_feature (301)..(301): S = C/G
agctatcagatacacagcaatttaacagttaccacatctgacttcaatgaatacacagtctggtagagtcttctaaaatgataattaccaaactacatagaaagcgagcactatttgtggtctaacgttaagaggaaaacaaatcagattataaaaccatctgtacattacgattgcaactctaaacatgtgagagtgtgaacaaggtctggacgggtgaatacaggaatgacaatattgatgtggttagattggatgactttttctttagcattattacaattgttttcgagctttaaasttttagattgttccaaacgtttctaggggggaaaaaaaagctgctcccatagccctggctccccaggttggcagtagcatgaatgatggggtattttcccagatgggcaggggcttgccacaaggtgactgggaggggatattcaaggcagtccaggagagttgggttacggaaggctatcactctgtagacttgggagtgctcactgggtgccatcgtaagaaccagcctcttctgtgtctgggctatgccacgcagcagcacctgcaggctcttccaagctttgtcagcaccacaact

SEQ ID NO: 44 - DNA, 601 bp, Homo sapiens
  misc_feature (301)..(301): R = A/G
gttggggttggaatccatcccttcttatttgggggcagggtttttctatttcccttactggcctgggagcaggtggagatgcatgaggtcatatggaagagacaggctgataggatgggtggagtcctttgggaaggaggaggcaatggggaatctattggtaggaccccatggtggacgtatgagaagccaagcatttgagttttgactcgatgcagtaggcagtggggagcccttgcaggtttggggacatgatggaagagggcttaatgaagacgaggctggtgtaatcaggggagargctggatcaggcacatggtaagggtgatgtgtggcatttgttttgtgtaatcagaatagtacccacccatccaacttcttggaaatatgtatttctgcttctccatgagattggactggaagcttccatcttatatatcccttccccatggataacagcaccttccagggatgggcacctgatacaaacttggcctatcagagcacttccctgggaattttgcccttggggccagagaaacatgggtgtcagtccctctctggtgataaagctgtgtcatgtaaagtctgggggatctat

SEQ ID NO: 45 - DNA, 511 bp, Homo sapiens
  misc_feature (256)..(256): Y = C/T
ttatatatcccttccccatggataacagcaccttccagggatgggcacctgatacaaacttggcctatcagagcacttccctgggaattttgcccttggggccagagaaacatgggtgtcagtccctctctggtgataaagctgtgtcatgtaaagtctgggggatctataatgactaaaagatttgagagtcagagagagggaattctagcttggctcaggccctggtttcccctcactttgagggctcagacayccttttgcttgtgccacaatatgaacaatattcaccaccctcatttaactaaactagtctgagttgaatttttgtcatctgcaaaccaaaaagttctgatgacatttgcagtaagagaaatgtctactctttgtcattcaaagagttcaatttgttcattcttcaaattttgagcacaattctcaacaacactctagggttgttttgtgtgcattgggtccatcattttgtgcctgtaagaaataacaacaaaaa

SEQ ID NO: 46 - DNA, 601 bp, Homo sapiens
  misc_feature (301)..(301): Y = C/T
acctgtatgggaaatgcctggctgtcctgtgtgggcgctcagtccacgttgatttctcctcatctgaatcacaaaggagcaggcatggaagtgttctgagcagcaattttacttaccacacgagtgatggagatgcattgctccttctctgaagggaatcccaaagccttgtgtctacagagaacctggagttcctgaacctgatgctgactagtgaggaaagatttttgttgttatttcttacaggcacaaaatgatggacccaatgcacacaaaacaaccctagagtgttgttgagaaytgtgctcaaaatttgaagaatgaacaaattgaactctttgaatgacaaagagtagacatttctcttactgcaaatgtcatcagaactttttggtttgcagatgacaaaaattcaactcagactagtttagttaaatgagggtggtgaatattgttcatattgtggcacaagcaaaagggtgtctgagccctcaaagtgaggggaaaccagggcctgagccaagctagaattccctctctctgactctcaaatcttttagtcattatagatcccccagactttacatgacacagctttatc

SEQ ID NO: 47 - DNA, 449 bp, Homo sapiens
  misc_feature (208)..(208): Y = C/T
cctaggcgtctgggcagcagccattttggtggcagcaccccagttcatgttcacaaagcagaaagaaaatgaatgccttggtgactaccccgaggtcctccaggaaatctggcccgtgctccgcaatgtggaaacaaattttcttggcttcctactccccctgctcattatgagttattgctacttcagaatcatccagacgctgttytcctgcaagaaccacaagaaagccaaagccattaaactgatccttctggtggtcatcgtgtttttcctcttctggacaccctacaacrttatgattttcctggagacgcttaagctctatgacttctttcccagttgtgacatgaggaaggatctgaggctggccctcagtgtgactgagayggttgcatttagccattgttgcctgaatcctctcatctatgcatttgctggggagaagt

SEQ ID NO: 48 - DNA, 601 bp, Homo sapiens
  misc_feature (12)..(12): n is a, c, g, or t
  misc_feature (301)..(301): R = A/G
  misc_feature (318)..(318): n is a, c, g, or t
gaaaatcataangttgtagggtgtccagaagaggaaaaacacgatgaccaccagaaggatcagtttaatggctttggctttcttgtggttcttgcaggaaaacagcgtctggatgattctgaagtagcaataactcataatgagcagggggagtaggaagccaagaaaatttgtttccacattgcggagcacgggccagatttcctggaggacctcggggtagtcaccaaggcattcattttctttctgctttgtgaacatgaactggggtgctgccaccaaaatggctgctgcccagacrcctaggctgatggtgangccatgctgcacggtccggttgttcatggagttggcggccaggacgatggccaggtacctatcaatgctgatgacggtgatgaagaatatgcttccaaaaaagccgatgaagaagaaggcggtagtgaatttgcacatggcattgtggaggcccttttcatttatcaaatagtgagtccagaagggcaaagtggctacaaacagcagatcagacaaggccaggttcaggaggtaaatgtcggtgacactcttgggcttcttgctgttggtgagggcaaacact

SEQ ID NO: 49 - DNA, 701 bp, Homo sapiens
  misc_feature (501)..(501): S = C/G
agagagagagagagagaagaacccatgagccaaagccttaattagagtccagggcataatctaagcaggcttcccacagggagttctaactgggggtttagagctagcaggcaggagttctgtggagccacactgtgactgagaggtggttgctgcagtatatctgcgcagcctatgagggacacaggagtcaatacgtaagtcaagtaggttgtagctgtatgtcccatagggagctggtcacaaggagatggttgtataaggcagacatttggattaaccaccttggggaactgggaggaggtagagaattggaaattgtgtccaggtgactaagccctgcttctggcatgagaaagtccaacttacattcaaaataaatcccaaggcaacatataaatataagaactcattattctacacctgcctctttattcctactgtgacacctttccttcccctttactcagggttccaggaagaagccctggccagacagcsccggagatcaagcatctcctcctggggatgcccctcccttggaagaacaaaaggagctccattatgcctcccttagtttttctgagatgaagtcgagggagcctaaggaccaggaggccccaagcaccacggagtactcggagatcaagacaagcaagtgaggatttgcccagagttcagtcctggctggaggagccaca

SEQ ID NO: 50 - DNA, 501 bp, Homo sapiens
  misc_feature (251)..(251): N = A/C/G/T
ctcccctcaggcccctgccctctgcaatacgccccctgaccttgcagcagcaggacagagccgctctgggacccatagatgttccaggccttgcagctgactttgaggtcggagctgagccccccgtggaggatcagggagctgttggcccagggcccagctgagctggagttgaccttgaatgagccctggctgctgttcccctccagcggcttctcctcaagccgccagcacagggagggggccggccnggctcgaaaggagcatctgcagtgcagaccctcagcctcccaggagcaggaggggcccagcaactgtgggagggctgtggggagggaggacagaactcagcagggggcctcttccttctttaataccatgcagttcctgctccagctgcccccacactcacagtaaactgagagattcagaaaaatttgcaggaagcccagcgggtgctgagcgcggcaggtgaagcctccttcttctgcagaccttact

SEQ ID NO: 51 - DNA, 401 bp, Homo sapiens
  misc_feature (201)..(201): N = A/C/G/T
ccggccgggctcgaaaggagcatctgcagtgcagaccctcagcctcccaggagcaggaggggcccagcaactgtgggagggctgtggggagggaggacagaactcagcagggggcctcttccttctttaataccatgcagttcctgctccagctgcccccacactcacagtaaactgagagattcagaaaaatttgcaggnagcccagcgggtgctgagcgcggcaggtgaagcctccttcttctgcagaccttactcgacgaagctccaagatcccggtattggagatgggggtggcgttcagggcaggggagccctggaaccagctcaggtgtgcaggggggttgctgggagcatcacagagcagccgcagagcctggccctccaggaccggaaggtat

SEQ ID NO: 52 - DNA, 601 bp, Homo sapiens
  misc_feature (301)..(301): Y = C/T
gatgggcatgggcccaggaggtacccaaagaggagccacagaaacccaccaagcggggaaggctgtcctgtctcactccccgcagatcccaaggcttagatccacacacaaggtttctcaagttattgttttgtttctctctgtcttccttacacacacacacacacacacacacacacacacacacacacccctcactcccactgcccttgaggactcagctgtgtccccagcaccactcacaggagacattgagctggacagttctctccgtggtcacctgagctccttggcgtttcayctgacaggtgaggttggtgccatggtcctcgggcctgggggtgagggtgagctccgaggagcgggtggtctcggggtccagggggctgagggcattccccgtccaggagaatgtgagaggtggtcccgcttcacaggatcctggaaggctgcagctcagccttgtggggcggccggactccagaggctccagaaagtggatgtcgggtttctctatcagggctgaggaggagacagggagatacctgggccccaggggcttgaggacgtaaggtgtgaccccgagagtggccaggcctca

SEQ ID NO: 53 - DNA, 998 bp, Homo sapiens
  misc_feature (500)..(500): R = A/G
cccgcttcacaggatcctggaaggctgcagctcagccttgtggggcggccggactccagaggctccagaaagtggatgtcgggtttctctatcagggctgaggaggagacagggagatacctgggccccaggggcttgaggacgtaaggtgtgaccccgagagtggccaggcctcaggccccgacctgccccaagtcctacacctcctccagccgcccctgcccaactcctgtccctgttctcatacgggggtctccacgtcccagggtcctctcctggggtccctgccatacctgtcacctccaagttcagcttattctgttggtagctatattttacatcccttcctctctccacgcggaagaaatagcttcccgtgtcctccattctggcatctccgatgctcagggagcagttcttcttctggacatccccaaggaggcggaatcggccctgggtctctggcttcactcttctgtctgggttgtttgtggccacarcctcagcgtagtatgggatctccccgtcccggaaccagtagacgtagagtgggggagaggaataccaggatctccaggggtaagagaaggagcagggcacaaggacgcacaggccctcctgcaccgtcaccgacttctgcacttgcagctcgtacactggcttctcctgcagggaccctggggggacacagaagctcagctgcagctccagccccccttctcacccctgtgcctgtccctcctccctcagctcactcacccccccacagcaggggcagcagcagcaggggcagcatgtctccatccgccagggccccagcccagtcccaggtccggctgtcagggaaggaaatgctccaaatgtccaaacgtggggtggggctgagaaagccccgacaggaagccggagggtgagtgagagctgtggacgcgcacagaaggggaacttgggcatcacgtgctgttggggtgaggcgggggctgggaagccattctgct

SEQ ID NO: 54 - DNA, 501 bp, Homo sapiens
  misc_feature (251)..(251): N = A/C/G/T
gcctcaacctccatgatcaagtgatcctcctgcctcagactcctgagcatctggaaccacaagcacacatcaccacctctggccttagctctgtgtttctgagattcagtctctcctactccctacaaacaccaccctgtaccttccctgggaccaagacttacattaaaaagaagatgaggcacagacagatacagagcagggccatgacaccagcaccaccaagggctgcaggaaccactcctgtcccnaggttcgatctccctgcagaaaagaggggcgtgcaataactcactcccaggactcagactcttgtcctcccacctgctgggcaacttgctccagggccctgctcagacaggagatgaagaaccctgtctccccaccaccagtccagcctctctctcccaccatccatcactctgggatccatgcccctcccctcaggcccctgccctctgcaatacgccccctgaccttgcagcagcaggacagagccgc

SEQ ID NO: 55 - DNA, 501 bp, Homo sapiens
  misc_feature (251)..(251): N = A/C/G/T
cagggccctgctcagacaggagatgaagaaccctgtctccccaccaccagtccagcctctctctcccaccatccatcactctgggatccatgcccctcccctcaggcccctgccctctgcaatacgccccctgaccttgcagcagcaggacagagccgctctgggacccatagatgttccaggccttgcagctgactttgaggtcggagctgagccccccgtggaggatcagggagctgttggcccagggnccagctgagctggagttgaccttgaatgagccctggctgctgttcccctccagcggcttctcctcaagccgccagcacagggagggggccggccgggctcgaaaggagcatctgcagtgcagaccctcagcctcccaggagcaggaggggcccagcaactgtgggagggctgtggggagggaggacagaactcagcagggggcctcttccttctttaataccatgcagttcctgctccagctgcccccac

SEQ ID NO: 56 - DNA, 801 bp, Homo sapiens
  misc_feature (401)..(401): R = A/G
gaacccaggatgagttatcctactaaagaaggaagtgatacagctggaaatgctcacaaaaattctgaaaatgagcctcctaatgactgtagtacagacatagagtctccatctgctgatcccaatatgatctatcaggtagaaaccaacccaataaacagggagccaggcacagcaacctcccaggaagatgttgttcctcaagcagcagaaaacagcgagctcgaaacagagatccaaaaagatcaacgagaagaagatctaaaagaagagcttcttctacttcagacccccattcccagaaaattggtctctcacaagcccttaaatgatagatcaagatcccactcagggaaagttgagatgaaagcaaacaatttccccataaatcacaaaactcrttttcgactttcaacttcatggagagtcccatttattaacagtcatgagataagaagtatgattctccatctgctatgtgatagatatttctctcaggctgcagggtgtcagaataccatgtgggtaaagcgaaaatatatagcatgtctttaccatccaaatagtttcacccatcacgagagagccataacatttagaaggccttcgagggtgcactactaccgtcccctcactgagagaatgacatcaggaaaattttgcaaatcaactgacactaaagggaaatgtagattccgtgctattgtgaggtctgtgctctttgtgtcacagatacaaattgaaagtatttttaatataaaaggttttgtggatatattgacatatatccataccatgaat

SEQ ID NO: 57 - DNA, 801 bp, Homo sapiens
  misc_feature (401)..(401): M = A/C
tgggtaatacagatccatcttattcaatgaaaattatttataattcaccatccaaaaggaaataattgggccttctcttcagaactaaatgtgttctagtgcatagggtatatacctaaaatagccaaatgagaggttatgttattccaagtttactgaaattccataattaagttatgagaaaacatatttaataggaggcttacatttgccctcagttttcactttattctgtgggtttgtgactctgatacaatatttatagttgcgagaaggcacagaaatagcacattcacaggctttttgccatgaccaaagaattgacttcttataaaatggaacatacataaatttagtaaatctttgtcttctttcccataaatagaacccaggatgagttmtcctactaaagaaggaagtgatacagctggaaatgctcacaaaaattctgaaaatgagcctcctaatgactgtagtacagacatagagtctccatctgctgatcccaatatgatctatcaggtagaaaccaacccaataaacagggagccaggcacagcaacctcccaggaagatgttgttcctcaagcagcagaaaacagcgagctcgaaacagagatccaaaaagatcaacgagaagaagatctaaaagaagagcttcttctacttcagacccccattcccagaaaattggtctctcacaagcccttaaatgatagatcaagatcccactcagggaaagttgagatgaaagcaaacaatttccccataaatcacaaaactcgttttcgactttcaact

SEQ ID NO: 58 - DNA, 801 bp, Homo sapiens
  misc_feature (401)..(401): S = C/G
atgaaagcaaacaatttccccataaatcacaaaactcgttttcgactttcaacttcatggagagtcccatttattaacagtcatgagataagaagtatgattctccatctgctatgtgatagatatttctctcaggctgcagggtgtcagaataccatgtgggtaaagcgaaaatatatagcatgtctttaccatccaaatagtttcacccatcacgagagagccataacatttagaaggccttcgagggtgcactactaccgtcccctcactgagagaatgacatcaggaaaattttgcaaatcaactgacactaaagggaaatgtagattccgtgctattgtgaggtctgtgctctttgtgtcacagatacaaattgaaagtatttttaatataaaagsttttgtggatatattgacatatatccataccatgaatgttatgatcacaaacaccaataatggttggaaatacttttgtcccatctgtggaaggctttttaacacttactctgaattaagacaacattcatgcagctcttctgggaattaaattaaattggggtaaattcattttaaaatataacttctaaaattcataatttgactactaaagtaagacaaaattgcatgaacataaattttagtattattagagggagtagcagaaaggaacacaaactaatagtacctctcagtaagaaatacctatggggagtgaggaaacatctgtttatactttgcttttacaagtacatcattgaaatatcagacctgtcatctatattgagtcagcatttga

SEQ ID NO: 59 - DNA, 801 bp, Homo sapiens
  misc_feature (401)..(401): Y = C/T
atgcagctcttctgggaattaaattaaattggggtaaattcattttaaaatataacttctaaaattcataatttgactactaaagtaagacaaaattgcatgaacataaattttagtattattagagggagtagcagaaaggaacacaaactaatagtacctctcagtaagaaatacctatggggagtgaggaaacatctgtttatactttgcttttacaagtacatcattgaaatatcagacctgtcatctatattgagtcagcatttgaaccaagtaaatgttttcactgtcttaacatctatttctgtagatgtaaatattgttaacataaaagaatccaagttaacaggatcctgactaagatagcaaacatatattggaaggccagacaaagttcyaccaagtgtttccagagattctgctacatgtattatctgaaatgttctccatatattcaataaaaaccaatttgaagacatagaaagttgtattgtatatttgtaattagagaagaattcctatgtctggaataaaaagattcaacatactataaaatacacaatacttgggtaattttgaagatacagaataataacaaaactcataaaaaagtatatgatagaagtgaaacagtttgaagtaaaagtgaacaaatattaaattgataccatataactgtaaacctttttgcttgtatagcacattcaccattgttcacaatcactacacaaagtttaccttcccctccatacatacatgcacaaatgtgtgcacatatttaagacgttccttatcttg

SEQ ID NO: 60 - DNA, 601 bp, Homo sapiens
  misc_feature (301)..(301): W = A/T
gcaaagtcacattgctgtgggcagggatacagagaagaatggacacttatggctacttttaccacctacccacagacgcgtgatctgaggtcgtaaacactggactgtgagagattgcacttgaggcaatggggtgtgcctcaactagacgtctagctcacatcccatcctacctccaccctgaggctggggccgcatcttaccatgtgtctttttattgcaggttggaagaatgtgggttaacgagcacctgctgtaaggatctcgcgtctgttctcacctgcagtaagaccctgcagcwgctcaacctgaccttgaacaccttggaccacacaggggtggttgtactctgtgaggccctgagacacccagagtgtgccctgcaggtgctcgggtgagctggggtctgttgtgctctatgggcagagtgctccgggctaagaagggattggctgggacctgcagtgtaatcacgttgcatttaaaatgcaaatgatgttccttgtctcagggttgttgcaggagtaagaaccaagcaggtgagtataaaactcttaccacagtaagtggtgaacagtgaatgtccaacaaatggaaacac

SEQ ID NO: 61 - DNA, 401 bp, Homo sapiens
  misc_feature (401)..(401): S = C/G
gacccgaaaagagccatggaagccttcaatcttgtaagagaaagtgaacagctgttttccatatgccaaatcccgctcctctgctggatcctgtgtaccagtctgaagcaagagatgcagaaaggaaaagacctggccctgacctgccagagcactacctctgtgtactcctctttcgtctttaacctgttcacacctgasggtgccgagggcccgactccgcaaacccagcaccagctgaaggccctgtgctccctggctgcagagggtatgtggacagacacatttgagttttgtgaagacgacctccggagaaatggggttgttgacgctgacatccctgcgctgctgggcaccaagatacttctgaagtacggggagcgtgagagctcctacgtgtt

SEQ ID NO: 62 - DNA, 501 bp, Homo sapiens
  misc_feature (251)..(251): H = A/C/T
aggttagtgtatttctgctgtttcttcaaagacccgaaaagagccatggaagccttcaatcttgtaagagaaagtgaacagctgttttccatatgccaaatcccgctcctctgctggatcctgtgtaccagtctgaagcaagagatgcagaaaggaaaagacctggccctgacctgccagagcactacctctgtgtactcctctttcgtctttaacctgttcacacctgagggtgccgagggcccgactchgcaaacccagcaccagctgaaggccctgtgctccctggctgcagagggtatgtggacagacacatttgagttttgtgaagacgacctccggagaaatggggttgttgacgctgacatccctgcgctgctgggcaccaagatacttctgaagtacggggagcgtgagagctcctacgtgttcctccacgtgtgtatccaggagttctgtgccgccttgttctatttgctcaagagccaccttgatcatcct

SEQ ID NO: 63 - DNA, 601 bp, Homo sapiens
  misc_feature (301)..(301): R = A/G
taagctctaacatccaaaaaggcctctagacatccccaaatgtcccctggggggaaacgtcaccccaggttgagaaccactaacataaggtgacttacctgaagggtcccgttccttctgactgagggaggctctgcctcagacatcttctgtttgagaagacagcgtagtgcgtatatgtgttacaagtggctcgtgttgaccgcctgcctgtggaaagctcgtcctttcttgaccacaggtcggattacagcctcatctgttggcatcacatctgctctgtgctcaccaccagcgggcrcctcagagagctccaggtgcaggacagcaccctcagcgagtcgacctttgtgacctggtgtaaccagctgaggcatcccagctgtcgccttcagaagcttgggtgagttgagaatcgacttcgactcgagtatgtcacggagatgacctattcatctcacctctagctttcagtcgaggctaactgcacaagcaaagaattaacatccagagcagttgctcaacctcagcacttacagacatctcatgcagatcattcttcatcataggggttgttctgtgcgttgtagggtgttaagat

SEQ ID NO: 64 - DNA, 200 bp, Homo sapiens
  misc_feature (101)..(101): M = A/C
tgaagtccttgctggccttctaaccaacaacaagaagctgacgtatctgaatgtatcctgcaaccagttagacacaggcgtgccccttttgtgtgaagccmtgtgcagcccagacacggtcctggtatacctgatgtgagtggatgttgggggtgcctactgtggagggccatggcggcagttcaaacctgggcctattg

SEQ ID NO: 65 - DNA, 801 bp, Homo sapiens
  misc_feature (401)..(401): Y = C/T
tgtgtgtttgtgtgtgtgtgtgtgtttgtgtatgaaaacctaaagaaaagtaataaacagctatcttacaaaatttggcagcataccagtagtgaagttgctttacaaaccagatgagtaattaatggttcaattttgattgaacaaagaatcagaatgaggtttgaaccagaatgaagtgaattcctaacagaaaggaatttacttgtaattttcttattaaaggggtgcctttattttagattatcctaatgcatagtaatcagaatactaggtatctgtttaggtcttgtgtatttttaagaaattattcattttaatgcattgttcaacttttgcagtggccataatataattgtgataatgtaataaaatcaggaaacattacctgaagcagatgyttttgaagtcaccagaaaatagtcttctccaattccaatttaaatatggaggtaatttaccccttattttattaaacgatcacaaagatgttggaagcatttttcttaatgaaaaccaacaaaactttgcatattgtcaagttacgtaacttctctaagcctttgttttctcattggtaaaatatgtatggtaacattgtctccctcacgggatggatgtgatgagtatctgaggtaatgcattaaaaaggtaagcacactgtgtgtcttgtagtaaatacttaatatgttagggattattcaataatgtgcattattattttaacaaatatatctttaaatattaaattcccttagtcatatgtgagaaattgtgttggcttttaaaaaaacaaactta

SEQ ID NO: 66 - DNA, 601 bp, Homo sapiens
  misc_feature (301)..(301): Y = C/T
cgggcagccatctgactccaatagagagagagagttcttcacctttaagtagtaaccagtctgaacctggcagcatcgctttaaactcgtatcactccagaaattgttctgagagtgatcactccagaaatggttttgatactgattccagctgtctggaatcacatagctccttatctgactcagaatttcccccaaataataaaggtgaaataaaaacagaaggacaagagctcataaccgtaataaaagcccccacctcctttggttatgataaaccacatgtgctagtggatctacytgtggatgatagcggtaaagagtccttgattggttatagaccaacagaagattccaaagaattttcatgagatcagctaagttgcaccaactttgaagtctgattttcctggacagttttctgctttaatttcatgaaaagattatgatctcagaaattgtatcttagttggtatcaaccaaatggagtgacttagtgtacatgaaagcgtaaagaggatgtgtggcattttcacttttggcttgtaaagtacagacttttttttttttttaaacaaaaaaagcattgtaacttatgaac

SEQ ID NO: 67 - DNA, 511 bp, Homo sapiens
  misc_feature (256)..(256): M = A/C
cattatcctaaatgtgccatttggtggtccattacttcagacctttgttttttttgagggtaggcacttaagcttaacaattttttatctttaatcaatttttctccccatagatctctgtggtaagaagtgctactttagagacaaaacctgaatcaaaatatgtatcactcatcacgtcataccagccattttccttagaaaaggaggtggtctgtgaagagccgttgtctccagcaacagttccaggcatgcmtaccgaagacaatccaggaaaagtggaacatacagaagaactttctagtataacagaagtggtgactactgaagaaaatattcctgacgtggtcccgggcagccatctgactccaatagagagagagagttcttcacctttaagtagtaaccagtctgaacctggcagcatcgctttaaactcgtatcactccagaaattgttctgagagtgatcactccagaaatggttttgatactgattccagctgtctgga

SEQ ID NO: 68 - DNA, 511 bp, Homo sapiens
  misc_feature (256)..(256): R = A/G
ctagatgtctactcttcatttaaataattttggtatcctggtgaattctacttttcttcaaatatacatatctgggcaatgtggcatcttacaataaggctttccaatattaatgttagtttcttacaattgtcccttttacttttttattttcttacagtgcctacaccaactaatgttacaattgaatcctataacatgaaccctatcgtatattgggagtaccagatcatgccacaggtccctgtttttaccrtagaggtaaagaactatgggtgagtgtcactcttttatttatcctttttattccatttttgtttaggtccttggaaattccacaactgtgttctttcatcagccttcccacgtggcaaaacattctaaactgcttatagaggtccaaaagtactaaagatgcaaattctttgccaaatatttcttgcctcttatttcctcttccttatcagtattgaaatagagaagtatcactaaacttctgagattagcatga

SEQ ID NO: 69 - DNA, 1029 bp, Homo sapiens
  misc_feature (993)..(993): R = A/G
ttgagtgccaagtaaagatgtcagctctacggagcttacattttagaaggagaagaaaacaaatatcaaggtgtatattatagtgtacagcaaggtgaaaagtgccatgaaaaaacagtagggcggggtaaggaggaggagaaggtgtgttgcaatttaaaatttttaacaaaagttcatgatactcagagaattgaaacaggtgagatcattagacattcgcatgtttgagcacaagcgctgaaggacttagcaatgtggctgcagtggaataggagagatgcaaaataacagacaaacccagagaggtaagagagcagacctcttcatgagaggctgcctaataaactgatttgacactgaattgctgagaaggtaatgcaaatagtttttttctccaagaacaaagtagttcttggtcaagccgatttgatttgggctgtgggaatctgcacaaaccatttcactagctaagtctcaggttcctcaaatgaaaaagcagggactggaaatggcttttgaagtctcattctcttctaaaaatgtcaggctccaagacaaccaggtgaagtccaagagttagtaaaataaggattgtggctcggctgtggcctaatgcaaacttgcacaaccccaggaaaccgaaaaaaactggaagaagaattgcagaatggggtgccaggttgaaagaccttaacctttgcactcaaattcctcccacacccagaagtccaggtcccgaccgcacgacgccgtgctcactgctgggtgctgcgcctgagtccgcctcctgcggcttcccggacttgaccccgcccacgccctggtcccgcctcctgccgacgccggcacagaccccggtgacggaagtgacgtaaggccggggctggagggcagygctgggctggtcccgcaggcgctcggggttggagccagcgaccgtcggtagcagcatggctctcctctttctcctaccccttgtcatgcagggtrtgagcagrgctgagatgggcaccgcggatctggggc

SEQ ID NO: 70 - DNA, 401 bp, Homo sapiens
  misc_feature (201)..(201): M = A/C
tgaagtggctacaaaggtccctggggcatcacctgctcacctaggaaccaggagtactggatactgttccgttactggtaacctatctggatgtaaaggttcataagttacaatgctttttttgtttaaaaaaaaaaaaaagtctgtactttacaagccaaaagtgaaaatgccacacatcctctttacgctttcatgtamactaagtcactccatttggttgataccaactaagatacaatttctgagatcataatcttttcatgaaattaaagcagaaaactgtccaggaaaatcagacttcaaagttggtgcaacttagctgatctcatgaaaattctttggaatcttctgttggtctataaccaatcaaggactctttaccgctatcatccacaagt

SEQ ID NO: 71 - DNA, 601 bp, Homo sapiens
  misc_feature (190)..(190): n is a, c, g, or t
  misc_feature (301)..(301): R = A/G
  misc_feature (466)..(466): n is a, c, g, or t
  misc_feature (477)..(477): n is a, c, g, or t
agagtgatcactccagaaatggttttgatactgattccagctgtctggaatcacatagctccttatctgactcagaatttcccccaaataataaaggtgaaataaaaacagaaggacaagagctcataaccgtaataaaagcccccacctcctttggttatgataaaccacatgtgctagtggatctacntgtggatgatagcggtaaagagtccttgattggttatagaccaacagaagattccaaagaattttcatgagatcagctaagttgcaccaactttgaagtctgattttcctrgacagttttctgctttaatttcatgaaaagattatgatctcagaaattgtatcttagttggtatcaaccaaatggagtgacttagtgtacatgaaagcgtaaagaggatgtgtggcattttcacttttggcttgtaaagtacagacttttttttttttttaaacnaaaaaagcatngtaacttatgaacctttacatccagataggttaccagtaacggaacagtatccagtactcctggttcctaggtgagcaggtgatgccccagggacctttgtagccacttcactttttttctttt

SEQ ID NO: 72 - DNA, 801 bp, Homo sapiens
  misc_feature (401)..(401): K = G/T
tagtaagatatctgatggctttttaaaaattctaaaactttgtttttaatattactatgggacctttcattaaaaagaaatggcaacatctgattcacccattatcctaaatgtgccatttggtggtccattacttcagacctttgttttttttgagggtaggcacttaagcttaacaattttttatctttaatcaatttttctccccatagatctctgtggtaagaagtgctactttagagacaaaacctgaatcaaaatatgtatcactcatcacgtcataccagccattttccttagaaaaggaggtggtctgtgaagagccgttgtctccagcaacagttccaggcatgcataccgaagacaatccaggaaaagtggaacatacagaagaactttckagtataacagaagtggtgactactgaagaaaatattcctgacgtggtcccgggcagccatctgactccaatagagagagagagttcttcacctttaagtagtaaccagtctgaacctggcagcatcgctttaaactcgtatcactccagaaattgttctgagagtgatcactccagaaatggttttgatactgattccagctgtctggaatcacatagctccttatctgactcagaatttcccccaaataataaaggtgaaataaaaacagaaggacaagagctcataaccgtaataaaagcccccacctcctttggttatgataaaccacatgtgctagtggatctacttgtggatgatagcggtaaagagtccttgattggttatagaccaacagaag

SEQ ID NO: 73 - DNA, 501 bp, Homo sapiens
  misc_feature (251)..(251): R = A/G
atttgtttgggaagcctagcatctaaattgtccagaaaatacgtaaaggctaaaaaatcaatagataaggatgaagaatttgccggttctagtccacagagttccaaatccacagttgttaagagcctgattgataactcttcagaaattgaggacgaggatcaaattttggagaacagttctcaaaaagaaaacgtgtttaaatgtgattctctaaaggaagagtgcattcctgaacatatggtaagagraagtaaaataatggaagccgaaagccaaaaggctacccgggaatgtgagaaatcagccctcacccctggattctcagataatgcgatcatgttattctcaccagatttcactcttaggaatacattaaagtctacttcagaagacagtcttgtaaagcaagagtgtatcaaagaagtggttgaaaaacgtgaggcatgtcattgtgaagaagtaaaaatgactgttgcttcagaagctaaaatacagctg

SEQ ID NO: 74 - DNA, 200 bp, Homo sapiens
  misc_feature (101)..(101): R = A/G
gacgaggatcaaattttggagaacagttctcaaaaagaaaacgtgtttaaatgtgattctctaaaggaagagtgcattcctgaacatatggtaagaggaartaaaataatggaagccgaaagccaaaaggctacccgggaatgtgagaaatcagccctcacccctggattctcagataatgcgatcatgttattctcacc

SEQ ID NO: 75 - DNA, 601 bp, Homo sapiens
  misc_feature (301)..(301): R = A/G
taaaagttccagaaatgtgaagtacaaagatttttttgatccagttgaaagtgatgaagacatagcaagtgatcatgatgatgatctgggttcaaacaagtggatgaaattgctgaagaagcagcagaagaactaagcatttctgaaatgtgagtatttgaaccatcctttacattgtgagctggaattgtccaatcatgtattggtacttgtggttttcacatatgtttgttttaagaagttagattctctcctatcagatattctcaagatagccagaggaaagtctgtggatttaaarggacattagagatcatttaatgaagaaaaatattactggcagtagcaatcaaacatttcttgccaggaaccttgatttggttttgtaccccaaaaatcctgttatttttgtgagattgatggtttgtattatcaattgatgaataatttattttctatatattggacacttttgttctgtttcttacatagcatgtcacttaaatgataccttctcttccgtaatacctgaatgattttggaacttctgagtatttggttgcattaggcatataaaagaagaactttattaagggaaaat

SEQ ID NO: 76 - DNA, 401 bp, Homo sapiens
  misc_feature (201)..(201): R = A/G
ttccggggattccctttttagaaagattgaaggatgcaatggcaaatataaactcaatactatgaaaaattaatggaatttcagcctcaaagaacattttcctcccttcctttgtgtccttattctaatcctcctcccctggaattacacttttttatgtgttgactctacctaggctgttactatcagcctgaatggggrcgggatgagagtacctcctatccactaatttgcttaaggataagttctaagacgggctagaaaaaacactagacctggccgattctatcaagaacaatggcaaactgaacagaggcagtcaggaggccaaatgtctgattctttgttctgtacctttcagtagtctgcaaattttctaccaaaaaaaatcccaagaattt

SEQ ID NO: 77 - DNA, 501 bp, Homo sapiens
  misc_feature (251)..(251): S = C/G
tactcggctatttttttattttttaaaattttacttatagagatgtggtctctattttgcaggttaagcctcctttactcatcaaagtacttatttaattcatggtttaaaattataattctacattactattaacaaccataacttttagaaataattttatttctctaagttttttaataagtatcacttacatattcctaccaataagaaagccatttttgtcttgttatatatccaacaacgtcctstgtgtccacatttattaacatcccgtaaaatacaagaagtttctcctgacattttaaagattgatggtccaggaatagtccctatgaaaaatgcaatgattgtaaattctttgtgaaaacactattctcttaaacatgtaatgcacacacagataatatatatgaatgacgactcatcattcaaaacatatcacttaaaattagctaataatttatttataaataggattgttaatcactggaaacaatg

SEQ ID NO: 78 - DNA, 3333 bp, Homo sapiens
  misc_feature (3293)..(3293): N = A/C/G/T
tcccctgactcgctgagcctctcctggaccgtcccccagggccgcttcgactccttcaccgtgcagtacaaggacagggacgggcggccccaggtggtgcgtgttgggggcgaggagagcgaggtcaccgtggggggcctggagcctgggcgcaaatacaagatgcacctgtatggcctccacgaggggcggcgcgtgggcccggtgtccaccgtgggcgtgactggtgagtagtgcttggagtctcggggtaaccacctttccctcatgggtacctggtttactgctgtgccctttcaccaagccctgtgggtccagacttgtctcctgtgtcctgccctccctctgtgccctgtggctgtggcctatgctagcggtttgcttgttcactttggcgtggcctccctctaatggtcaaccactgataacctccaagagtgaaatatgtcaggcgcacaccaagcctgacttacgagaattttcctttctttccatcttaataacagcattctttgttataaccacatacacaaatgcacacaagaggaacaatccaacgtcaaaccacgttgggatgactaaataatttaggcaacatctataaaaagagctattatgccgccactgaaatgttttaacataagacccttactttataatgttacattgaaaaaagagagcctaggctgggcacagtggcttacgcctgtaatcccagcactttgggaggccgaggcgggctgatcgcctgaggtcaggagttccagaccagtctagccaacatggtgaaaccccatctctactaaaaatacaaaaattagccaagcatggtggcacatgcctgtaatcccagttacttgggaggtggaggcacgagaattgcttgaacccgggaggcagaggttgcagtgagccgagatcaccactgcactccagcctggcagatacagccaaactcagtctcaaaaaagaagaaaaaggagcccaaatttttgtaaggatgctaatcacaaccatttgaaagtaacaggcatggcaagaagactggaaagaaacacatcccacgggttgcctgatttgttagatagaatagaatattccagcacatttttttctgtattattctattctgcatagtccaaattttcttaaatggcaaacatttcttttacaatcagggaaagggaaaagagaaaatatataatgtcttctccttctttacactccatctgtcctactcctctatcgctcttgtggcttatttcatttatttccttcttttttttttttgagatgaagtttcgctcttgtcgcccaggctggagtgcaatggcatgatctcggctcactacaacctctgcctcctggattcaagcgattctcctgcctcagcctcccgagtagctgggattacaggcatgcgccaccacatctggctaattttgtatttttagtagagagggagtttctccatgttggtcaggctgctcaaactcctgacctcaggtgatctgcccgcctcggcctcccaaagtgctgggattacaggcatgagccaccgcgcccagccagacttatttcatttctaattatgaggaagttcaaaatttctagtccataagaaattggaggggtggagatcatgaggttaattgaattccaaatgctcagtcaggctgccttttctaagtcatcctcagccaggttgttatgcctggcttagagtatttttcgagaattcctaccgatggggaagaatcagccctgctgagaggcggtctcttgcagggcaggtcgccacctctgtggcaccaagtgaggtgcgagctcatctcccaaaggccatccagacagaggaagcactctcaatcggcatccccgattcctgggggagaggcctcatttccatatgcatgttcagaggaccatctgagtgttgggaaacagggggaatagggaaattattggaaaatgaacattagaaaaattcacattccgggggtaagctgtcctggtccacgttcagttttgtgttcctgtctccactgtggggaaccacagaactgacagaggacaggctgagggacccacccctgcccctcctgttctatgtgtattgctgccccacccccaccccacactctattattaattgttgtagcccagaatttctttctttctttttcttttttttttttttttttgagactgagtctcactctgttgcccaggctggagtgcagtggtgtgatctcagctcactgcaacctctgcctcccaggttcaagtgattgtcctgcctcagcctcctgagtagctgggattacaggtgcatgccaccacgcctggctaatttttgtattttcagtagagaccgggtttcatgatattggccaagctagactcgaattcccaacctcaggtgatccacccgcctcggcctcccaaaatgctaggattacaggcgtgaaccactgctcccagcccagaatttcttttttagcccacgtttttctagtgaaaataatacagcaacattatgtggaaagcttgaaaaacagaaaacaagaatctcatagtcctactttctcccccagctgccggcattaataacaatgtgtgtagtgcacattcccttcctgtattttgcatgcagagcgtgttttaaagttgcaatcagtgttcataaagttcttggcacttccttttttgtacacaagtacattgtaatcattcacctcacggctacacaaccagcattcatcatcgtttcaatggttatttgatgcgttgcggtgaaagcactataacaaaattaatcatcttctacgggtcatttgtgttcctgacacatctgctgtcatgaataaccccatcgtgagttcttccatgctataactttttcctgctttaataattttcttaggacagatgcccagaactgggattattgggtcaaaggaaatgagaattactttggctcctgacactatgtctcagttgccttctggaggtttctaacagtgcagctctgccagcagtacaggccgggggctcggggatacctcaccggctcttattccaagagtcactgaacggcgaacacaaagctgccccagccctcagcctgctctggaggggcgcatttgatgtatgacctctgttgacagcaccagcaaagcaagttgcccttaaacccttaaactctgtatccccctatattacctttcagccccacaagaggatgtggacgagacccccagccctacagaaccaggcacagaggccccagngccccccgaggagcctctcctgggggagctgacagtgaca

SEQ ID NO: 79 - DNA, 701 bp, Homo sapiens
  misc_feature (201)..(201): S = C/G
gtctatcatttggcaaataggaattacagttgcctttagataggcaattcttgataattctgtacaaaaatgggtaaactttcaaaccatcttttcctagacattaaagtatgtgtcctttgtggatgaatcccacattaggatggtgaaccagcagctactagggagaagtctgcaagatgtcaagggccaagaagtccsagtaagttaaatcattttgtcttttttttttttttaagaaaatttactgttaaatataaacacatctagaaacttgtacaaatcaaaactgatggattttaacaaagtaaacatactcatataaccggcactcagattaaacaattgaaaattactagcaggagtcccttttatgcccccctccaatcactaccctctctttctccttttttaatttttaaaatttggctgggcacggtggctcacacctgcaatcccagcactttgggaggccaaggtgggtggatcacttgaggtcaggagttcgagaccaacctagccaacatggtgaaacctcgtctctactaaaaatacaaaaattagccgggtggtgtggtggcacacatgtaatcccagctactcagaaggctgaggcaggagaactgcttgaacccaggaggtggaggttgcagtgagccgagattgtgccattgcactccagcctgggtgacagagcaaga

SEQ ID NO: 80 - DNA, 608 bp, Homo sapiens
  misc_feature (409)..(409): K = G/T
atagtgatatcaagtgcgaagaccaggccctgaagccagcctgacggttccagctgttaggagaaagtgaaggtgggtgccatggatctgatgatttcagtgattttctactcaagaaaaatgaagtctcggatgggcagagcttaactgccttaaaaacttggtacagggcaaggtgtgagtttcccggtgagactgtgtgaactgtgaacgggtagagtctgaaactacaaaccagatgtttccgggctccctcccgcctggtctggcctgtcttccttctgctgctatgcagttcatcctgggtccctgagggcctcgcagatgcttcactcgaaagattggagttgcagagtcccctgtggaggaattgaactgccccctctcgcaggaccccagctggcaaggktttgttcctccctggagggtagagaccctcactgaggccctggagaggggcactcaggggcagcagctcattcccaaagttctctggtggagctggggagtggcaccctgggaactctggggtttccccaccagctcctctctccagtctttggtgtccaggtacagtctccaggccgtggcttctcgagttctgtatg

SEQ ID NO: 81 - DNA, 1048 bp, Homo sapiens
  misc_feature (969)..(969): Y = C/T
tcctaacataggttaatatcttaaatcttaaaaaattaagtatatgaaaactgtccttttaaaattatctttatttggtggtaggagtggcttcaccttctcaagaaactgacagttcagtgattgacggcctaaaataccacatagaaaaacagacatctcttcccaaatgctgagggtagatcctgtcatttctggggaaagctactatttccctccccaaaacagcaaagtaacaaataagcgaaaaataattatacacaaagaaggaaacaaattattcaattattttaagaaaaaaaattgcaaaattttcaacatcttaaaatatgattggttatttctcaagacagaagcaacagagattaaaatgacataattaaggtactaaggtacacaagaagatagggttgttttaaagattaaaataacagaaattaataaatcaaaaataaaaacagaattaagtgcacattataatactctgctgtcaggactcagaactttccaaaggacagtcagaaataagaggaaaaattaaagcagaaaaaagtaaaatataaagtagcttactactttgccgaagtgtttcattcatttatagttactgaatatttctttccataacatttctaatacaacttttcatctttcccttctgttattactcctgatttttcactgcaacttcacaatataggtaagacagaggacacaacttctgttttagagatgaggaaattaatgttcaaaacatttagtgacttgcccaaaatcacagagctagagaatagcaaaagtcggactcagctctttaatctcaagactgtttgtaccacacctgaggagggggaggagggaatgggattgtctatctccatgccttctgaaagtctaaatctaagtaatgttacacttttcaatttttattataggtagtataaaatgtttacaaacaactgaagaacytccttgtaagtttcccatatatacaactcagtcctttttttactgacacctaataattgtacaaatttatgggatacat

SEQ ID NO: 82 - DNA, 601 bp, Homo sapiens
  misc_feature (301)..(301): M = A/C
tctttcccaaggtatcacagtatatgaccggcttctaaatttaatcctagaagaaaatattgagagtataagaattatgatcttttcatttgatcatttcaggattgtctttatatcttttatttgcaggtaaacaatcatggggcctggaaaatgaggctttaattgtaagatgtcctagacaaggaaaacctagttacaccgtggattggtattactcacaaacaaacaaaagtattcccactcaggaaagaaatcgtgtgtttgcctcaggccaacttctgaagtttctaccagctgmagttgctgattctggtatttatacctgtattgtcagaaggtattatgcagaaggctcccatcttctttcaccctgctcccctttcttcagtggttgattgcctgagctgcccttgctttcattccttccctagtcctttctggaacagttaaatttataaaatgatttgaataaaagtgatttggataaacttctaggaatactatcaggttgaggtctagctcattctgagctatttggatttacagttgcagggattgatttgtagctgacttagagaaaaacctagctttcctagtg

SEQ ID NO: 83 - DNA, 2001 bp, Homo sapiens
  misc_feature (1001)..(1001): Y = C/T
aaccacctttctcagaattgcctggaggaggtgcttgttaaagatgcaagccccttagtaccactccagatctgttgaaagaaagtatctggggatacagcctaggaaatctgcattttaacataattccttggatttttatttaagattgtgtttgaaaaatgtcaagatagaggcaagcaagaggatcacctaggagagtaaattagtaaaagatggcagtattagcaatctcattagtttgactacattcattccaaatttaagagtgagtcctaagttaggcttgtttccttgaactatgtgaggagaaaaagctttaactagcaaaagaacgtattaaacaagatttggagaaaaattccttttccaccttaaaaaaacccaatgtacaactctggattactcttagcttccttatttcaaatactttccagtttatgtacttgaaataaatacaacaacttctagaacagcttgcagttcagatctggcttttactaattgtaatcaaacataattctggaggaggaaagaaagaaaggggcaatgaaggaatgggagagaagaaagagtaatgcaggaatacattctaacggttccccttcaaggggcagcatggcagagggggctggggtggaaagtgggttgcaaaatctacgaagagttgcgatagggaagaaaccaggttgaggaagcagccagaatgtcaccctccttcctaaacatgtttttttctcctatgcagggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacaytggggctcctgagcccatccttcgggactggagtaagtgtatggcagatggatggaattagggtcaaagcagagaaaatgagatgtggatcgatacatggtacatggtagacagcgaagtgctgaaaatggggactgagtctggaggaacttacggggggcttaggaccagaatggggaaatgggataaagaaatggaaatatttaggttggtgcaaaagtaattgcagtttttgccattactttcagtggcaaaaaccgcaattacttttgcaccagtttaatatttagtctgtgctattgctgctctggtggtgtggctgatgttgctgcgtctatgtttgagggtgagaggggagcgtgcttgctttgaaatgaggctgtaaatttggcaatcatattttcagaaccccaaattgtaatacactattctagcctccttagatttcaactattctggtgccagaagcagatgggagctgaaggaatgatgaaggttgaagaaggggggcttttcttggtgtggggcagtactgcatttggcctgctctaccaagcatacgggagtagtaaagccacggctggcagaccatttggcatgcatgctcaggggccagtggataaagaattacttacagttcaaacactgtttgaactcagtgtcgggagtagttaaaggtatcgtgagaagttgcacacagctttggggactcttggaaaagaaagaggaagaaatgaggaagaggaagggtgtctacaaagggccagagaacaggatctcagatcagctgctgtaaccaggtttccccttgtgggaagtgttgtttcttgctgggcagttgggaagggaatggagaacagagaagagagtggaaatcacatgctcacttgaactttcctggggaacgtctcctcacagcgtgcacaagagcctccctttagaaatggagtgttcattttatcatgggaaaagaatctgagtgggacatgattcagaacag

SEQ ID NO: 84 - DNA, 801 bp, Homo sapiens
  misc_feature (401)..(401): S = C/G
cctgccttcatggatcaccagctcacgtcatgttgccttctcttttctttgtgtgtgtgtttatttaagttatttttcttcctcctctcccttttctttttggccctccctccctccctcttctgccatgtaactggaggatgtgctatgagtttgcaaacagctggactgtcaggctgctttttttccagatgttcctcctctgcctccccttcccctcctctcccctccttttccttccttccttcctttccttggagcactgagcaccatttggaagcttgagagaaaccaaaattaaagagagaaagagagagcgtgcacgctcctgctttgtctttcctgtgtgggctgtttgcatccattgtctcctccagaggtctgggggtgtcactccaggsggatctcagccaggggctggaaaggcccccctgtcctccctatacggcacagccagagtgtctgcaggggctggcaccccacttcctggctgagggtgaactccagcttggggaggtggacctgggaaccatggggcaccttggccacggtgaggtgggggtgcagctgccctggagactgtagtgtactcagcccctcggcttccagcctctggctcagcacttgtgccatgctttccagtgtgggagagggtggggcacacagcacatgcgggcccaggaggaccagctttctaaagctcagccgagggggtgcatttagccccggggccaagagggcccgtctcagagctccaatggcagcggcctcctccccagcgcctgccagtcgcagcagggc

SEQ ID NO: 85 - DNA, 801 bp, Homo sapiens
  misc_feature (401)..(401): S = C/G
tgagtcaggaaacattttcagacctatggaaactgtgagtggatccattggaagggcaggcccaccacccccaccccaaccccagccccctagcagagacctgtgggaagcgaaaattccatgggactgactttctgctcttgtctttcagacttcctgaaaacaacgttctggtaaggacaagggttgggctggggacctggagggctggggacctggagggctggggggctggggggctgaggacctggtcctctgactgctcttttcacccatctacagtcccccttgccgtcccaagcaatggatgatttgatgctgtccccggacgatattgaacaatggttcactgaagacccaggtccagatgaagctcccagaatgccagaggctgctccccscgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacggtcagttgccctgaggggctggcttccatgagacttcaatgcctggccgtatccccctgcatttcttttgtttggaactttgggattcctcttcaccctttggcttcctgtcagtgtttttttatagtttacccacttaatgtgtgatctctgactcctgtcccaaagttgaatattccccccttgaatttgggcttttatccatcccatcacaccctcagcatctctcctggggatgca

SEQ ID NO: 86 - DNA, 801 bp, Homo sapiens
  misc_feature (401)..(401): B = C/G/T
accatgcagtcggtggtggagaaacttatcctcagggggcatgaggtggttgtagtcatgccagaggtgagttggcaactgggaaaatcactgaattgcacagtgaagacttactcaacctcatacactctggaggatctggaccgggaattcatggatttcgccgatgctcaatggaaagcacaagtacgaagtttgttttctctatttctgagttcatccaatggtttttttaacttatttttttcgcattgcaggagtttgtttaatgaccgaaaattagtagaatacttaaaggagagttcttttgatgcggtgtttcttgatccttttgatgcctgtggcttaattgttgccaaatatttctccctcccctctgtggtcttcgccaggggaatagbttgccactatcttgaagaaggtgcacagtgccctgctcctctttcctatgtccccagaattctcttagggttctcagatgccatgactttcaaggagagagtacggaaccacatcatgcacttggaggaacatttattttgccagtatttttccaaaaatgccctagaaatagcctctgaaattctccaaacacctgtcacagcatatgatctctacagccacacatcaatttggttgttgcgaacagactttgttttggactatcccaaacccgtgatgcccaatatgatcttcattggtggtatcaactgccatcagggaaagccattgcctatggtaagtcacctctcctttagcacattaggaataatctggctttggaaattaaaaaaagattcc

SEQ ID NO: 87 - DNA, 501 bp, Homo sapiens
  misc_feature (251)..(251): M = A/C
atgtggaacactcctttgccacctagaataatcaggaaaggtgacccatgccctgtgcctccttaacagactttcaggtacttgggaatttgaaacaaatctccttgatgcacaaagtaaccttttcttcccccattgtaccccaggttgaaaatcgatgactttaatgatgaactcaataagctgctggaagaaatagaagaaaaaaacccacaactgattattgatactgagaaacatcatccctgggmagaaaggccttcttctcatgacttcatgatctgaatccccccgagtcattcattctccatgaagtcatcgattttccaggtgtgggtgaactgcctgtgactcctctcctcccccgcccctacccctcagggataatgagttcattgctgggctagatgttttagccatgattctgcctctgttttatacctgcacacgtccttatctttgttacatatgaaatatctgtatcacgggtatattgagaga

SEQ ID NO: 88 - DNA, 601 bp, Homo sapiens
  misc_feature (301)..(301): R = A/G
tggatgggcagcagaacaaggccatagatgagctggggcaggagagccatgagccctagtgtggaggtggggaaaaggaggacactcccagtacctggtgggacaacctgggtgctggccccaaggggctcctccagagagatgtgtgtgacctggcaggtgtaagtggcacctgcagagccaggttctgcggtgagagaggaggagatgctgtaggtgcctgccacgctttgcctgaggctggagaaggaggcaccagagacttgggctggggatccacccagctcctctcgggtccacrtcaccaccacatccagagggtaatagccagcaatgtcgcagatgagggtgggcagcagagcttcgtttgccaagctcagtcgtactttaggggaagctggagaaagaatgaggaataagattacacatggatctaactggggacagcggaggagcctgaagccttttcttcctgccaagatgagagtagattgtggaggctacagtgtcccttggtggtgtaccaaggcgggggtgtgtgaggggcccacctggatgcaggccgtaagggggcagggttacattttccagaaaacagata

SEQ ID NO: 89 - DNA, 801 bp, Homo sapiens
  misc_feature (401)..(401): M = A/C
agatgatagaaagcatagtaactgattcccctggccctgctgggtcttgccaattgacaggatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagamagaacctgaagagccagcacaggcccctcctgcccaatctactcctactccaggtgtggctgcggctcccactctggtgagtggtggtggcagtaccagtagcaccagcagtggcagcttcgaagccagcccaggtatggagatggggataggtactaccagatgtcagatcactgcttcaaggtgcttaaaggtgcagggtggtaaggctggggataaatgaagtagaaggcagttgttttggtttattggactatcagtgatagtgttctatcatttgtatatctgaaggagggaaggttttgtctggaatcttaggttgtagtctaataccatttcttggcagagtactgtagctcacgcctataatcccaacacttagggaggcttggggtggagg

SEQ ID NO: 90 - DNA, 801 bp, Homo sapiens
  misc_feature (401)..(401): S = C/G
gtcctcaggttacagagcagaggatgcacaggctgtgccagcagtgaatgtttgccctgaatgcacaccaagggccccacctgccacaagacacataggactccaaagagtctggcctcacctccctaccatcaatcctgcagaatcgacctctgctggccggctataccctgaggtgctctctcacttcctccttcaggttctgagcagacaggccaaccggaggacaggattccctggaggccacagaggagcaccaaggagaagatctgtaagtaagcctttgttagagcctctaagatttggttctcagctgaggtctctcacatgctccctctctccgtaggcctgtgggtccccattgcccagcttttgcctgcactcttgcctgctgccctgascagagtcatcatgtcttctgagcagaagagtcagcactgcaagcctgaggaaggcgttgaggcccaagaagaggccctgggcctggtgggtgcacaggctcctactactgaggagcaggaggctgctgtctcctcctcctctcctctggtccctggcaccctggaggaagtgcctgctgctgagtcagcaggtcctccccagagtcctcagggagcctctgccttacccactaccatcagcttcacttgctggaggcaacccaatgagggttccagcagccaagaagaggaggggccaagcacctcgcctgacgcagagtccttgttccgagaagcactcagtaacaaggtggatgagttggctcattttctgctccgcaagtatcgagccaaggagctg

SEQ ID NO: 91 - DNA, 601 bp, Homo sapiens
  misc_feature (301)..(301): M = A/C
tgttgactacataatatgtccaaaagaataacgcaaaagtgctagatgaccaaactctgaggccaggctttggggacatcactttaaaatcactcctctcatagtagtagaatctcaaatacaacaaagtctttaaatggctttggcatttaaaaaaagtctattgaaaataaagactgaccaatctgcagggagccgacagagatggctacctgaaatacagatgtcacctgaaatgcaatttgtaatggaaatacctgattttcttacctggcttcatcaaaccttattcagctgttgmttccccttctggttcaatttctggtgcagtaaggccttctggagcaggagggaaggggccactagatgactttacagatgtacctgagtgcactgcttctgcagcttccccagagagcacaggtttgccttccatctcctggggtacagagttttccccagactcctcctgcccagtattgtcagagactattgaagtgatctccacttcaaggtgcagagatttttcagagcctattttgatagcaccttctgcatccaggagttgtgcaggtacctcaggctgacctttcaaagatgt

SEQ ID NO: 92 - DNA, 601 bp, Homo sapiens
  misc_feature (301)..(301): Y = C/T
atagcgtaattgaaccattctttcattaaatagttctgtgccttttacttttactggagtttgaaaagacaacaatcagaccaagtccccacttcaaagtcccaccttatggccctgccctcaccgggaaaggttctgctccttcctggataacaaagccttcaatgatgtgggtgagaatctggggcttcacgatggcctgtgggggttttgagtcacccatttgtctagacaccatggctagtgtaggaggcggtactgaaggggcgggggtcaaggctactagttcactgcttggagyattagcattcacattagccactgattcagctttttctggaaaacaaacacagattaagcaacagacatgagatgacatattgatccatctattagttgagccagcatgatcttccataataatctatgtccacccttgacaattcacctggattccctgtttttggatctattcatttgtccaccaacttctggcccattttctactcaaccagatttatcttttagctcactcagaacattcctctactctgtgtgctctccaacagcattagaagtcagttactcacctccaagactg

SEQ ID NO: 93 - DNA, 601 bp, Homo sapiens
  misc_feature (301)..(301): R = A/G
tctccagtgtgaactctctgatgatcaataaactgagacaacttgaggaaggctttcccacattcactgcatacatgggcattctctatgttgtgagttctctgttgcttaatgaactgggacttattaataggttttgcaattgcaggaaacttcatttcagtataaaattgtttatggttagcatgaaaaagggatttcccatctctattaaactcagcagagttctttaggccagagctccttttctggttttcaaaacttaaatttgattttaaaggtttttcatgtaagtcaaacrtatcacaatcttgcttcagcaggaaatgacctttgttctgattaacaatatttccaaacatattctgttcatggcactgtttcacactcttctgaatactttgattttgcaagtgatgctgcagaggatcatcaattttcctgatttctaggaaagaagagaacagtcaatcactccatcatcttgttttgaaataaactatttaaactattttttaaaactgccttggtgtgaggtgactctttagtgaaaaccctattttatttatttatttttttgtgagcaataaagctttttaat

SEQ ID NO: 94 - DNA, 401 bp, Homo sapiens
  misc_feature (201)..(201): N = A/C/G/T
tgtatcctataatttgccccatttccagtgagaaccagcgtaaaacatttctagaacaaacagtatattgcacaaggatagatttacaacaaaaactagtttttctaagacttgaagccttctgtcttttatcacagggggacccaggaagcccaatgatgtgccagctacagcagttcgatctgtgggttctgagaggantcctgaacttcggtggtgagacgtgccctggcctgtttctgtacaccaaggtggaagactacagcaaatggatcacatccaaggctgagagggccggccctcccctgtcctcactccaccactgggaaaagttgatttctttctcccaccatggaccaaatgccaccatgacacagaagacatattctgattctgaactg

SEQ ID NO: 95 - DNA, 601 bp, Homo sapiens
  misc_feature (301)..(301): S = C/G
aatgagacatttcaagtggggacaagcatggggaaatagacatctcccacctcacctgtgtccatttcctctcctttctcttgcagcaagtcaaaaccgtgagatttcagaattacagccctcctcccaccaaacattacacctcccatcccacctccggaaagcctgaacagccagccaccctcaaggcgtcccagcctgaagcagcgtccttgggcccagagatgaccgtcctatttgcccaccgaagtggctgccactccggacagcagacagacctccggagaaagtcagctcttgscaaggccacaaccctggtgtccactgcctcaggcacgcagaccgtgtttcccagcaaatgaacctacgggtggcttttcctagaccccaaagaggtgaattgcatttaaatacagtctgcctccactgagggcatcctgccattctttggggacttgagcatgggtccttgttcttcctatttcacctccaggaaagcaaaagtgggagcagaaattcctgccctgggtgggaggatagatggcgtggccttccaaacatacaaacataatgatttgatgccacaaagctcacttactca

SEQ ID NO: 96 - DNA, 601 bp, Homo sapiens
  misc_feature (301)..(301): N = A/C/G/T
ttggtagaagagacatgcatgggagaaaggatgatgcacaaaagcagcctgttaaaaatcagcttggattaaacccgcagtcacatctaccagaactgcagctatttcaagctgaagggaaaatatataaatatgatcacatggaaaaatctgtcaacagtagttccttagtttccccaccccaacgtatttcttctactgtcaaaacccacatttctcatacatatgaatgtaattttgtggattcattattcacacaaaaagagaaagcaaatattgggacagaacactacaaatgtantgagcgtggcaaggcctttcatcaaggcttacattttactatacatcaaataatccatactaaagagacgcaatttaaatgtgatatatgtggcaagatcttcaataaaaaatcaaaccttgcaagtcatcaaagaattcatactggagagaagccatataaatgtaatgaatgtggcaaggtcttccataatatgtcacaccttgcacagcatcgcaggattcatactggagagaaaccatataaatgtaatgaatgtggcaaggtctttaatcaaatttcacaccttgcacaacatca

SEQ ID NO: 97 - DNA, 501 bp, Homo sapiens
  misc_feature (251)..(251): W = A/T
agcaactggcaaccaaagcccattattcctgcatgaacccctcctgaccacactggcaggggcaacatggtggccaacctgggggagctggccaagcttcgagacctgcccaagctgcgagcgttggtgctgcttgataacccatgcacggacgaaaccagctaccgccaggaggccctggtgcagatgccataccttgaacgcctggacaaggaattctatgaggaggaggaacgggctgaggctgatgwgattcgacagaggctgaaggaagaaaaggagcaggagcctgagccccagcgtgacctggaacccgaacagtcattgatctagcagcagttctagcctctaaagatagtaaggaagcctgcagggaggcagtgggaggaggccaagggctgggcaggtaggggaagaggcaagaggggaagctgctgcagaaggaggtgggagaggaaagcatcagacaagcaggacccttaaagagaggagggttaggag

SEQ ID NO: 98 - DNA, 801 bp, Homo sapiens
  misc_feature (401)..(401): D = A/G/T
cttgtttttcttaatggcaatgggaaaatgtattttgctggatttcccttaagataaaagacacatttttgactcctgtaatggtcattctcatagaaaataatgaagccaactaaatgttttaaatactgaatcccttacctctttcctagttgttgctgctgtgcttcaagtaactgaattgattttatctctaggctatccaagatgtattctcatacaagactgacttagagtattctttttactaggttggctaatagcagttaaattatttgtgccaaattgtgtctcacagtttgattttaagatgtgtatgttttattcttttaatattcttttgctgatttgaaacctacaggaaaacaattttgataatcttgattttgatttggatttgdtgccttgggagtcagacatttgggacatcaacaaccaaatctgtacaggtaattatgtgtttcactggtaaaagttttaaaaagatcaattttattttgtagtttggtcatactcaaaattaggtggggttattgggctattctggtaggttaaaagattcctggtgttatgcattctacttctggtatggcaattatgtaaacaaatttcttgccaaaaatggatatgaggagtttcatagttatgtttcagtagtgtaatgaatgaacagttcatatcagaaatagaaatagtgattttgaattatgaataatgtctctgtataagattaacctgagaaccagacagggcttagggaatcaaagggaagagcctgggttaccagaacctaggaacttg

SEQ ID NO: 99 - DNA, 801 bp, Homo sapiens
  misc_feature (401)..(401): R = A/G
cgcagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggtggggaccccagccccgccccgccccgggtgggagagcccgcctaggaccccgcgggcccggcacacgtgttctgtccccctcttcaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgrgataactcgggggacccggccgacccgcacaaggtgtacgcgctcagccgggagctgtgctggcgaggtgagcgacgccggctgccaagggcgttggcattcgtcctgcttgggcaaaggggaacattctctgggtcagatttgtggttttagaagctgttctgggagaggctgccagcaggcccaggacaggtggagagccacatccccacctcctcaggccacagcctaagggttcacagccaggaagctggtgggggctacaccaggctctccttgtatctctcactctggtgtcggggcctaacgcctgccccattctctctcagaaggcccaggcacggaccagactgaggcagaggcccccgcagctgtcccaccaccacaggtacccttctct

SEQ ID NO: 100 - DNA, 801 bp, Homo sapiens
  misc_feature (401)..(401): K = G/T
cacggatatttgcaggccccaccagatgtgagtagctgagtcctttggttctggaggagcagggaggggctgtccctgggtgactgtgggtccaggacacagagcagctcaccaaccaccattgtccagactgctttatctgagggtggctcccaggataaatggcatggtgggcaggaccttgccctggaaggcaggactgggtgggtgcatggggaggtgggggagggctaggagggggtggtcctcagagagggcacacatcgtcactctcctatcctgcctgctggggcccgtgaatgagcccagccaccccagccactctgtcccctgctgcctcctgaccaagcctcctcctcctccagctgtaacgtggtggccatccctgggaatgcaagcakggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacttcgctcttccagttggtaagtcgcaagaagtctcattcattcactccttctgtctgcctgtctttctgtctctctttcttcctctcccatggttttactgagagcccacggggggctggaccctgtgccctgtcctgggatacaggtggcagtgagactgctttctccccacacctggtgctatcattcaaaatccctaagtgcgtgggctggat

SEQ ID NO: 101 - DNA, 741 bp, Homo sapiens
  misc_feature (401)..(401): W = A/T
gagttttacaagaaaataatgaaggactgagagcatttttactcactattgagaatgaacttaaaaatgaaaaggaagaaaaagcagaattaaataaacagattgttcattttcagcaggaactttctctttctgaaaaaaagaatttaactttaagtaaagaggtccaacaaattcagtcaaattatgatattgcaattgctgaattacatgtgcagaaaagtaaaaatcaagaacaggaggaaaagatcatgaaattgtcaaatgagatagaaactgctacaagaagcattacaaataatgtttcacaaataaaattaatgcacacgaaaatagacgaactacgtactcttgattcagtttctcagatttcaaacatagatttgctcaatctcagggawctgtcaaatggttctgaggaggataatttgccaaatacacagttagaccttttaggtaatgattatttggtaagtaagcaagttaaagaatatcgaattcaagaacccaatagggaaaattctttccactctagtattgaagctatttgggaagaatgtaaagagattgtgaaggcctcttccaaaaaaagtcatcagattgaggaactggaacaacaaattgaaaaattgcaggcagaagtaaaaggctataaggatgaaaacaatagactaaaggagaaggagcataaaaaccaagatgacctactaaaagaaaaagaaactcttatacagcagctga

SEQ ID NO: 102 - DNA, 511 bp, Homo sapiens
  misc_feature (256)..(256): Y = C/T
gaggcatgaaaatcgctggaacccgggaggcagaggttgcagtgagccaagattgtgccagtgcactccagcctgggcaacaagagcgaaactccatctaaaaaaaaaaaaaaaaaaaaaagaagtagagtttggaacagacaaatggaaagggatatataactgaatgtcatttcttccttccttttctagtttgctgctgttcagttttccacaagctacaaaacagaatttgatttctcagattatgttaaayggaaggaccctgatgctctgctgaagcatgtaaagcacatgttgctgttgaccaatacctttggtgccatcaattatgtcgcgtgagttcccttttgcaggagagcacgtgtcctgtgatttgttctgggtgatctacccacttccagctgcagggcatgggaactcagtaggtaggtacagcaaggggcagtttattgtctgaattgaagtggaacaattttactgcagattcttttggttgtacgtaacagaa

SEQ ID NO: 103 - DNA, 501 bp, Homo sapiens
  misc_feature (251)..(251): Y = C/T
aacagaagtgattttttactagctcaagttgtcatcctcatatacatttttttccctttgtaccccttccaaacatacaattatttatgtaacaacatctaactaggttagggaaacacaataataaataatactgtcttaaaagagctctaatttgtgaaaaagaaatataatcacatggttaagagataatatgattaatgctataatctatataattatttttagaaaatgaagaatgaatgcatacygcctgaaggaagaacaggcgtcacacaggtaatgcttaaaatgtgttttaaagaacaggggaagaaatggtttacatatagattaggggcttactttttaaaataagtaatagcatgaagagaggcaaaaaaaaaaaaaaaaaaccacagcaagtatattcagagaaatatggaagctgagggtatttattagatggcttggagtatataacagggctttggacacgtaagtgaaattatacatatatat

SEQ ID NO: 104 - DNA, 842 bp, Homo sapiens
  misc_feature (249)..(249): Y = C/T
ctgctgcatcttctcattgcatcctcattccatttcaggttaaattttggtgttggactccttagaattctacctacagcatctctgacaaaagcccgccaggctccgcttgactctctgcccggtgcgctgtcagatggcgccaagcccaagctctttcctttgcttcctgtagaagcccgtcctagagccctgggctgtgaggaggagcagccccacagggtcacactgtccttttcccttgcagaycttggcacccgccatcaactggttgccttttctcaacaccatcttctaccccgtggagatcaatgaatccgagcctattgtggtctatgacaaggaataccttgagcagatctccactctcatcaacaccaccgacagatggtaagaggacccccagtggcctggggcacgcctctcacagacagccctcttcttgggcaggtgggcaggggtggggatgacagtctgactcaggagagtgggacctgggcgggcttttacgagaggcagcaggacatcctggttacaggcacaggtttaaatcccagcctctttcaaactaccagctttgtagccttgggcaaatttcgtaacctttcttaagttcattctcctccttcataaaatggtgatacaaatatcacctgtggccgggcatgaacgcccgtaatgcgggacttttgggagacagaggcaggaggatcccttgagtcccctgcgtttgagacccagcctgggcaacatggcgagacgtgtctctacaaaaaataaaaaatagccagacatggtgtcgcgtgcctgtcacccagctcttgagagaggaagctgaagtg

SEQ ID NO: 105 - DNA, 801 bp, Homo sapiens; identical to SEQ ID NO: 22
  misc_feature (401)..(401): R = A/G

SEQ ID NO: 106 - DNA, 888 bp, Homo sapiens
  misc_feature (501)..(501): R = A/G
tcttcttgcagtggctcatgcctataatcccaaccctttgtgaggttgatgcaggaggatcctttgagctcaggagtttgagagcagcttgggcaacacggtgaaaccccatctatacaaaaaatacaaaaattagctgggtatggtagcacatgcctgtagtcccagctacttgggggactgaggtgggaggatcgcttgagccccggaggtcaaggctgcagtgagccatcatcgcaccactgcactccagcctgggcgatagagtgagatcctgtctcaaaaaacaaacaaagaaaaaatgacttctcctttatactttaaaaacagtatgtcactgttaaaagtcagcttcagttatgactttcagaaaaaaatctgtttcgtggaataaaaccatctgttgacaaataattttaatctatatataattttaaatgtgtaaaattttagttctccaccttcatctatggaagataaatcagatgttggttatggacraagtatttcttcttcatcttccttaagaagatcaagtaaagaaaagaacaagtaagaaaatgatgttttatctgtatgcaaacagcttcccctttaatttgagtgtgaaaaaatgttttagattttagattggggcaacttgatttttattcttcttatggtaatacaattgcataattgccttttacattgctatgggaaagatctctggaataggagccaggaaatctggtttcaccttctatttcgccctgtggacctgcagtgatttgggccacatgacttagtgtctgtgtgggtttcgtttccttagctgtggacgaaataacaccgggtccctggcttcatcatggggaaaggaatcaagttatataatgaagtaaaaat

SEQ ID NO: 107 - DNA, 601 bp, Homo sapiens
  misc_feature (301)..(301): W = A/T
agcctccatagtagctgggattacaggcacacaccaccacacccagctaattttttgtatttttagtagagatggggttttgctatgttggccagactgtagtaagtcgtttttatagtgtacatcttggaggaaagaaacaaaagattaatgttgactaagtgggctaagaagaggatcaactgtcacaacaggatccatttcttggctctggttaagattgtttcatttttctttcactcacctgtctcatagtaatcatagactttaacaattgctggcttcaagtctcctactgggwtgtcttgcagaaccatgaaggaaaaacttagcgtctgatttgtcacctgaaaggaaaagtgggagtaatcaagaacctagaaaacctccttctttctcccatgagcaaaacatattcttattgttctttgactctttttcaccagtgtctttaggtgaccagacatttgtggatgtcaagatgggttttagaatgcatccttgggaactctatttacagtcaacaaattttcacagattttcttctaaacaactgagccaaccctattcttttgtagtcccttgttatgagattaactct

SEQ ID NO: 108 - DNA, 601 bp, Homo sapiens
  misc_feature (301)..(301): R = A/G
agagaactcacactggagagaaaccttacaagtgtaatgagtgtggtaaaacctttattgggcattcaagcctaactaaccatcaggtaattcatactggagagaaaccttacaaatgtaatgagtgtggaaaggcttatgtgaagtggtcccaccttagacatcatgagagtattcaaactggagagaagccatacaaatgtaccaaatgcggcaaggcctttagacaatgggcggacatcaggattcaccaaaaaatctatgctggagagaaacctcacaagtatgatgagtgtggaaraacctttacccaggcctctcacctcactatacatcagattatccatactggagagaaaccatatgaatatgacatatatggcaaagtcttcagtcaaaattcacatttcaaaagttatcataggatttgtactgaagagaagccttacaaatgtgtgtggcaaggtcctcagtcaaaattcgcaccttgtaaatcatcagagaattcatactggagagaaatcctacagatgtcatgaatgtggcaaagcctttactcaaggctcacgcttcattaatcatcagatagttcatactggag

SEQ ID NO: 109 - DNA, 501 bp, Homo sapiens
  misc_feature (251)..(251): N = A/C/G/T
cacaggtggcaatagccactgtgtgccacaacttttcaatggcaatgtctggttcactggctgctgattctgtgtcacattctgcaaattccatagggacgatgcctgccttctgccaacatttcaccactgtggatggcttgactgaccaccacgctgcagcaatcatgtcgatggcctgcttgatgtccacctcttctgatcctcactgctgttgagcttgaggaggatctgttttagaaggtggctcnggtacagtactttcatggtgtgaattatgccaagattcagtggctgcaggacagcagtacagttggagggcagatacccaacctgaatcctttccaagtgtggaagcatgttatgagcagagcagttgtctatgagcaagaggatccggcgttccgccctcttcatcctggcatccacttgcatcagccactcattaaacagatcccttgtcatccaagcccactggttggctcggtaatcacaagggag

SEQ ID NO: 110 - DNA, 838 bp, Homo sapiens
  misc_feature (501)..(501): Y = C/T
ttcaccatgttggccaggctggtcttgaactcctgacctcaggtgatttgcccggctcggcctcccaaagtgctgggattgcaggcgtgagccaccatgcccagctcccatttttactttttatactgtattttcactctaccttttctatgtttagatatatttagatacacaagtacttcatattgttctacaattgcctacaaccttcagtacagtaccatgccgtgcaggtttgtagtttaggagcaatgggccctaccatacagcctaggtatgtaggagccaatacgctctaggtttgtgtaagtacacactatggtgttttcacaatgacaaaatcacctaacgatgcatttctcagaacatattccagtcattaaacaatgcctgactgtatatttgctttgtagaccagtgaagaagtgatgtctttgatgagttccctgagagttcccagccagtggcagagaaatatcacatataagtcaaaccctaatyggatattgcctgattctgtggactggagagagaaagggtgtgttactgaagtgaaatatcaagtgagtattaccatcccaagcctctgaaccctaggtagagctctttaaatgcttagtctagctacagaatttgacagtgaatcttacagtcccacgtgttactttctagttatttttgttattcttgtcttcccaactaaattataagttccttaagggcaaggatcacatattatattttatttatacagttggccctccatatccacagcttccacatctgcagattccaccaaccgtggatcaaaaatatccagaaaaaaatgaaaataaaa

SEQ ID NO: 111 - DNA, 801 bp, Homo sapiens
  misc_feature (401)..(401): Y = C/T
cattctatttatctcaacttcccattaattatatcactctccatcatttttatgatatgattttgtgttattgatatttattaaggcatattagtattctgtagaagactgagtatatttattgtactaaagcaaacagatttcacttaactgatgatcacagcacttgaactcaatcttatttaataagaccaagaagtcctggcatttgttttagctttgctttcattggttatacataaaattatgacttacttttaaaatgtgttcttcagctttggcttgcttcgtggcccctccaacaccaggtgaagctgttagtcccagtatctgaggaaggggaatcactggtttgttttctttcttgagtctattgtttttcaacttctgcatcaaataaygcctcatgatgttattatacactgcttctttgttggtgtgatgacattcatcaatgataatgagggaaaagtcttaaaagaaaattcaaagagttcatttctccatatcagcacactacagtgagaaaatagctttagaccagtaattgagctgccttggggatgccttctcttgggcacgacacaagagcagtccactttcagtttttaggagggaaatctaactatactagcacctgtacacacagacgttcgtatatactaatcatgaaactccctgttagacattctccttctttaatagataagattcagaaagtttacagagctaaaaagcgttagatgtggaattcacaccctggcttattacaaaacaaatctcaggattttacttttgttc

SEQ ID NO: 112 - DNA, 601 bp, Homo sapiens
  misc_feature (301)..(301): Y = C/T
gtcctcacattagtaaatgaaaaatcagttttgagcttaagtgacatggcaaagccactaagctacctagccacagagtcccaaaaagaatagttttcttgattctgatcccagtactttttccataataatacacagctgtccataagcaagccggtttcttttctttttcctttctgcttagaactcaccaaatctacaagctactgacaaatgggagttttggggaacaacttacctttaattcctcgattcattttcattaaacgcctgattatggaatcacagttatctccttgcytgatttcaattttggttgagaagtggccattggatggctggggattcaccagagaaacggacacaccaggctaggaaaacaacaagaaaatgattgtttaacttgaatactgctgagggaggaggaatctctgctacgttttcaatgcccaatgaaagacagatctaattctggtattttaaaatcatgactaaggagtactcaaatatgaaagaaaagctgtacaagctcatgcttataaccaaatgcctaggtaaagatgactacaactacatatatcaacaccaatgatggacacta

SEQ ID NO: 113 - DNA, 851 bp, Homo sapiens
  misc_feature (102)..(102): R = A/G
ctggcgggagtctggggggcacactgcagaccactggccgttgcttagaattgggtccaaatgtgacgagttcatttggaacagaggccttgctgggttccrgttggttgaggttgttgcaggagctggcactcaatgggttgagctcgatggcaggcatggcttgggtgtcaacaccaacactcctggccaggaggtctgggtcctccatggccacaggcttgtgagacttgcaacggcggcagtagaagagaagcccgacagtgcttatgataatgaacgccacggccactgtgatgatcagtaactcctgctgcccccagtcccccctttggatctcgggagtgactaggcagtgtccttctgaacaacccctcgcctccatttcacacctgcggagacagagaagtagtcagggggccaagtcatgaaattgccctttccatgtcccctcttacagagatctatgggatagagactgctccccccaaaacctaccatctcccgtttttcaccccccaaaaaagtaactatcaagcatatcaacatcagaactttccaccttccaccagtaaagtatgggtctcagctacatcctcatttgtgaccattaggatctgggaatgtctattatttttccagcatgagatctaggcactgtatacactctctatcatgaggtcgattttctccatatcactgcagtagagacatcgactctttagcatgatgtcaggggtcaaaatacagttagcattgcccagtattagcagccaggccccatgttccctgctgtgctttaacaggaagtacagagccaacgtgtccttgcagatcgccaccttacatgg

SEQ ID NO: 114 - DNA, 401 bp, Homo sapiens
  misc_feature (201)..(201): Y = C/T
ttcatccgaatccatctgaagagcattgagcaaattctgcacaaagacacatccatattacttgttgaatctagctatcctactttgtacaatattgcatactaatgttaaaaatgttttacttacattatattcttttacttttatagcatcttgttggacttgatcctcaagttttctcttttcctcttttattgtttyagattctgttttccaggtctccttttcactaaaaacaaaacaaaacaaaaagacaatactgtaaacctaataaaatgtttataagaaaagataacttcagattatgcaaatttaaagttttctcaacacaagaggtatcatagctattcagtatctgaaaacacaagaagttaaactttcatttaaaaagggtttagcct

SEQ ID NO: 115 - DNA, 1670 bp, Homo sapiens
  misc_feature (1490)..(1490): Y = C/T
tgtcaccaaaaaaaaaaaaggtgggaaaaatgaggaggcatgtacaaggcaataaagataatcagataatcaatacaaagaaattaaagaaaactattgggctatggttggcaagggcttaggaagatgggtagaaatatagactagagagggaggaaaggtaacaggttccagtctgggtgaacagcaagagcaaagtcacaaaagtagtcaccaggttgtgtgtgtgcacatgcatgcaagcaggtgaatgtgctggttggtgggggcgggggaaaatgatgggtctgttctgattggagatgacagtttaaaggaaggaagaacagaaactagccctaaaaaagttgagtggagtaacttttcagaaagccttgagcactaggtacaggaggacagacaccattttcctcttctgtaaaatgacagggttgaactagagatatattgtctttttcagctcaaaaattatgagcacaagtttatgagatagagttatgaaagacagcaagggaacaatagcatcagaaccatgtaggaagaaggcaaatccagaaaacagactgaggaataaagccatggaacccgaaatggaaaagaagaactgacaaagcttattaatgggctagatttaaggagtcaaaaatcacagaaaaccagcagtgccactgacaaagaagggaactgagcacacatatttccaaatttatgttcaacatctaaagtctgcaatgacaatttaaaatccaggtataaatatcctgcaagtcatctggaaataattagaccacatctatagccttaatgagcggaccagatcagagaagcaaggctaggaatcatgagcttaggaacaataatagaagtcaaggaataactgatctgaaggagagtatgtgaacaaaacagacagacactaggtactttgggatgccagccccatattggtacaggcatttggcagttaaaaaaaatatattctataaaaatataatctgcagccaggcgcagtggctcatgcctgtaatcccagcactttgggaggccgaggagggcagatcacgaggtcaagagatcgagaccatcctgaccaacatgctgaaaccccgtctctactaaaaatacaaaaattagctgggcgtggtggtgtgcacctctagtcccagctactcgggaggctgaggcaggagaatcgcttgaactgggaggcagaggttgcagtgagcagagattgcgccactgcactccagcctggtgacagagtgagactctgtctcaaaaaaaaaaaaaagaaaaaaatatatataaaatgtgcaatctatcgatgataattatcctgactggaacagaattcaactgaggtgttcaatatgacttatcacctactctatttgatatattggtgtttaatacccaccatactgtcgtcattccaaacaccagactgggctgcctgtccttggaatgaatcacttggttgttcatcctgyatgctagtctgattggagctggtggccaaagagggttgctcattattctggagtgaagaatgctctgaatctgtggatgaaggtatattaggcgctggaatgtcatcttgaagaatcaaacatatcaagtccccagaaacaatcccatatgaagccaaggtctcttcatctccagtgagg

SEQ ID NO: 116 - DNA, 801 bp, Homo sapiens
  misc_feature (401)..(401): Y = C/T
ctggcagccatgggcaccattctccacacagaaggcaggggacaggtgcacaaggcgctgagaccccagcagggctaactgtccttgtctcaggagccctacctggccagtcttgggccaggccttggggactgggagtaggggctgagccccgtctgtacagtctctggccccatgggcaccaggtgccagctcctcgcacccagtactcccattgctagggctgctggaacctgcagggtggcagagctgggcaggactcaccctataaccatgtccactgtggtgctgctgctgcagagaagtgtttccaatgctgcgacccgggtgtgtaggacggggaggtcacgatggcgcgacgtctgcagaaatttcatgaggaggtatcagtctagagttayccagggcctcgtggccggagaaactgcccagcagatctgtgaggacctcaggttgtgtataccttctacaggtgagtgcagaggtgacagcagggatacctcctgagggttggagacagcttcccccaggatatatcaaagctgcctccttactcccccatctcccagcttgggaaagtgtggagaattgagcagatggactttagctagaaatgtttgagaaatactgattagagcttgggcttcagacacaggtggtcgtggagtaaaatctggtctccatctctccctggctgtgtgaccttaagcaaataacttgacctctctgagcttcagtttcttcatctgtgaaggggagatagcaatcctgatttttgagattggaatgagaattgaagga

SEQ ID NO: 117 - DNA, 601 bp, Homo sapiens
  misc_feature (301)..(301): R = A/G
ttaaattctttaagacactctttgctgtattcttctgttttacttaacttagactgaatagtactcttttcttcaaccagattcttaagttgcttttcatatgtttcaactttctgtatgagagattgtgtggtaaagataagaggtttcattttggacttaaggtttagattttcactctccagttccattacttttttctgtatctgcacagattcttttaggtaattctgtaagtactgaatttttgcaacacactgctcagtaacggaattaactttggaagttttctcattttcaratattattgatccttgttttactagaaatggttgtctttctttgtctttcatttcatgttttgtttggtcgaggaaggacagtgtgtatcttggaactctggaatggaattttaaatctgtaatatttttgccagtgatgggaatttctttattgtttttctcatttttctttcccctgtgcatttcactcttagataactttttacattttctacaaaaatgcacatggaattttgacacagtttccctgaaggggagtaatttcttcactaatgcctctaattctgaaattctctttg

SEQ ID NO: 118 - DNA, 801 bp, Homo sapiens
  misc_feature (401)..(401): R = A/G
ccactaagaatttatacgaaatttgcatgcacaagccgaccacatttgccagagatgcacttctaaaaacccactgacatcagatacatgtagcccaactttctcaaacaaaaagttgtttcctggggtagttgtgcactctggaaaaacagtcactctgtggcctaaagtaaaggttaattttgcttccccccaccctttctcctttgagacctttgctttgagcagagtaaagagaatagtaattctggtatcaaatgaagactaatgcttggttaaaattatttttctttcctttcattagacaacagaggagacattggacttttattgggaatgatcgtctttgctgttatgttgtcaattctttctttgattgggatatttaacagatcattccraactgggtaggtttttgcagaatttctgttttctgatttagactacatgtatatgtatcaccaaaatttagtcatttcagttgtttactagaaaaatctgttaacatttttattcagataaaggaaaataaaaagaacaatgtttaataagtacttacccatgccaaactctctacaaatgtctttcctttaatcctcaaaatgaccctgccagaaaagcttcctggcctattttacaggtgacttaaatgaggcttaaagaggctaagtcctcagcccagaatcactgaacagtaagccctgagtccaaacacagctgatatcaaagcccatttctctcctttactacacggcgttttccattgtgcctcaaatttacctacagtgcctagattcttga

SEQ ID NO: 119 - DNA, 634 bp, Homo sapiens
  misc_feature (307)..(307): M = A/C
agttccttcacagctgcggcctccccgggtccattaacgaaggtggggaagggcggagaaagggtcggagtctgggaggagagcagctgcgggcgcgccagggcgctgacagtctggctcttggaggtaagatgggcgtggctgatcccgaactccgcctgcgtttgcagaagcgaagggaaccgagcgagcggagctgagctcgggtaggccgcgcgaggtccctcctctccgggcgtccgtgcgcctagctctgcgctgggagcctcgcgccctttgacagcagttagttgctgactcggatgcmgagagtcggtaacaccttctccaacgagagccgggtggcatcccggtgtcccagcgtgggccttgctgaacggaaccgggtggccacaatgccggtgcggctgctcagggacagtccagcggctcaagaggacaatgaccatgccagagacggtttccaaatgaagctggatgcccacggcttcgccccggaggaactgggtgggcaagtggatggccaatggctggtgggggaccgaccgcaacaactggaccttcagggccccgcccaggggtttgttaccccatgtcacaacatgtgcccccgcaaaaagcttcccttccacct

SEQ ID NO: 120 - DNA, 601 bp, Homo sapiens
  misc_feature (301)..(301): R = A/G
tggaagagcctgcagagggcaggcagcagagaaccggcagagggcatgggaagggccaggcagaaataaagggtagctcttgaagcatagatgacagtgtagaccgtggttcttttctcttgctttctccacctttctcttcaatagtttgtttctcctcattgctgttccaatggcaacctctattctgccctatcattgaaatctagaaaaagaaagtagctcaaatgtgaaatatcacctaatcttttcttctatttctccagagaaaaaatccatatacctgaaagatctgatgaarcccagcgtgtttttaaaagttcgaagacatcttcatgcgacaaaagtgatacatgtttttaattaaagagtaaagcccatacaagtattcattttttctaccctttcctttgtaagttcctgggcaacctttttgatttcttccagaaggcaaaaagacattaccatgagtaataagggggctccaggactccctctaagtggaatagcctccctgtaactccagctctgctccgtatgccaagaggagactttaattctcttactgcttcttttcacttcagagcacacttatgggcca

SEQ ID NO: 121 - DNA, 401 bp, Homo sapiens
  misc_feature (201)..(201): R = A/G
gcgcggtgctggctgtgcaccccgacaaggtgagcagagctgccaggcggccgcttgaggccttcaggggcggggcggggggggggtcctgccccgcccgcccccgcatgcttataagaggcgcttacaccgcctgtcacccataggctgcggggcagccgtacgagcagcacgccaagatgatcttcatggagctgaatracgcctggtcggagtttgagaaccagggctcccggcccctcttctgaggccgcagtggtggtggctgcgcacacagctccacaggttgggagccgtcgtgggacctgggtccccaccgtgaggaccccgtgggcgacagcaggtgtggccagggtggggctccgagccccgggtcaccgcccgcccagcgttccaggcac

SEQ ID NO: 122 - DNA, 628 bp, Homo sapiens
  misc_feature (429)..(429): Y = C/T
ctggcaatcagaccctccactcccacctggaagtcacccatgggccctgctgtactgacagccatgtccttgctgcatgtaggcactacacgaatgcacattctgtcccacccctcaccactcagtcaggctttagggctggcttcagtccaagagaagaggcccgcagactcccctgctactccttccacctcacagaggaagtctctcttgacctggaaaggtagaaggccacaattaggatgaagaggttcagggtgaattcacagaggatgggggtagatccaagaatgggctttttcttacaggatcctcagtgaagtgcattcggaatgaggatggaacttggttaacaccaaatgaatttgaagtcgaaggaaaaggaaggaacgcaaagaactggaaacggaatatacgttgtgaaggaaygaccctaggagagctgctgaaggtattataatgacgggacagataggtgacaggtttaaatccttgaaggagaagtggagctttaagagcagaaatgtgaagagctcccgttaggattcaacagcatgatttataaggagttaaatgttcatagaaaaaaaactgtgggtgacaaagttaggagcacatattgttcctg

SEQ ID NO: 123 - DNA, 601 bp, Homo sapiens
  misc_feature (301)..(301): R = A/G
tttcagataccctttaagctgggtgtcccaaatagtttacttcaattagtatttagtatcctgctttaaaagcctatccagtattttcatatctgttttaatatttagctcttatttttcaatataggcctgaagtgttagaagattcacctctggttccccaaaaaggcagttttcagatggttcactgcaattgcagtgttcatgaatgttgtgaatgtcttgtgcctgtgccaacagccaaactcaacgacactctccttatgtgtttgaaaatcacatctggtggagtaattttccrgtcacctctaatgtcagttcagcccataaatatgggtaagttatgcactaaaatgatgataataggtctaaacatcagtcatatataaaggttaaaaattgcttacaaaaatatttgctagcttatctcactttgcttaacactgtaatgatggtagatgtagtactgggggtattaagagtggcttctagaatgatttaacaatggtatgtatatctctgccattgtcacttaaattctgttttgaaaactgttttctttcaatcctggatctatgtaatggatgtgtattgattggat

SEQ ID NO: 124 - DNA, 601 bp, Homo sapiens
  misc_feature (301)..(301): Y = C/T
gggccattgagaagtctgaacagggctgtgtctgaatgtgaggtctagaaggatcctccagagaagccagctctaaagcttttgcaatcatctggtgagagaacccagcaaggatggacaggcagaatggaatagagatgagttggcagctgaagtggacaggatttggtactagcctggttgtggggagcaagcagaggagaatctgggactctggtgtctggcctggggcagacgggggtgtctcaggggctgggagggatgagagtaggatgatacatggtggtgtctggcaggaggygggcaaggatgactatgtgaaggcactgcccgggcaactgaagccttttgagaccctgctgtcccagaaccagggaggcaagaccttcattgtgggagaccaggtgagcatctggccccatgctgttccttcctcgccaccctctgcttccagatggacacaggtgtgagccatttgtttagcaaagcagagcagacctaggggatgggcttaggccctctgcccccaattcctccagcctgctcccgctggctgagtccctggcccccctgccctgcagatctccttcgctgactacaa

SEQ ID NO: 125 - DNA, 801 bp, Homo sapiens
  misc_feature (401)..(401): R = A/G
atgcttggagaatattgcttagtcatgtccatatttccacttccataattttttagtagttttaggttcatagtgggtcaacagcaacacattgacctaatgaccagaaaattgaatcttggaagaatttcttccactaagctctttggctgatctcttttgagaggaggtaaaaatcacaatgctgctgtccgaagaaaccctttgctctgtggaatggtgggaactagatccaagtaaatgtgcagagagcacatggtggtcttcggctttggttcctgggcctttctctactaaccttccactggactctgatttgtttctaatatagaaattttggttataatggtgatgttccttcttagctaacttatcttccccctactttccttcctaaggartactgcttaaatcttccatcagctttcaaaatatcatagaaggaactagaaatttccacaaagacttcctaattggagaaggagagatttttgaggtatacagagtggagattcaaaacctaacatatgctgtcaaattatttaaacaggtatggaaagaattactgtcacaggacatcagttccacttatttgttcatctttcatattaaaatatgtcatttttcatcaacattgaaaggggtatttgaaaataaaattttataagtggaaataagagatatgatttcagatgactggagaagtaaagacctgtcttgcaagaatgaggaagttaaatgctttccatccccagatgttatagcatgaaagacttttctgggctgggtgtggtggttcac

SEQ ID NO: 126 - DNA, 801 bp, Homo sapiens
  misc_feature (401)..(401): M = A/C
attttcaggtgttcagaaactttttttggtatatgactttgattttttacttttcattcatcttaaggtttgcacaagacattctttggtatgtgggaagataatattcgaactatttagtttgcctacaaaaggaaattaacctttagcaatatttaatacatggattgacaacaatatgtgtaaattatctatatgaagacttggtgccaataatctttccctttttttcttttaactgataaggaactatgctctgaatatcatctcaaatatatttttgttgttgaattgttctgttgtaggttacaaaaggtgtgaagaggaaagcagatacaacaactcctgcaacttcagcagttaaagcaagtagtgaattttctccaacattcacagaaaamtcagtggcactgccacctataaaagaaaatatgccaaagaatgttttgccagattctcagcaacaatataatgttgtgaagactgttaaagtaactgaacaattaaggcactgtagtgagattcttaaagaaatgcttgcaaagaaacatttttcatatgcatggcccttttataatcctgttgacgttaatgctttgggactccataactactatgacgttgtcaaaaatccgatggatcttggaactattaaggtaaatgttgccttaaaaggaagaacttctttttcttgattataaaagtaattcatcattgcaaagaaatcttaaaatctagaaaaagatgaaggaaattaagatcatccaagtcacactatctggagtgagtctctggaaaatt

SEQ ID NO: 127 - DNA, 699 bp, Homo sapiens
  misc_feature (589)..(589): R = A/G
tggatgactggactctaccccagacctatcaaatcagaacctctcaggttgggaaacraatcatctataatctatgtattataggtattttcctgtttctttgtctgtattaccttatatttcattgtctatctcttttttattttaattttttaatttttaaaaataactattgggtactacatttcattgtatatctctaaaggataggcatgtaaaaaacataatcatgatacattattgtatctaaaaaacttaactataattccttcctatcatttaatatccagttaattttcaggcataaccacaataccattgttatgcattaaaaaattaaggctaggcacagtggctcacacctgtaatcccaacactttgggaggtcaaggcaggaggatcacctggcaatattagcaactgattgcaataaatttttgcaaacccgatttaacactaatcttgaccttgttctttattaattagaacttgtttcctgtccacgcaatgtgtctgaatgcagccatgactgtgttctgacatcagaaggtcccttatgtttctgtcctgaaggctcagtgcttgagaragatgggaaaacatgtagcggtgagtttatttgctttatttaccttttgtttgtttgaaaacatacatttgctcagtgacatctaaaaattgatcttgttgtcaaggaag

SEQ ID NO: 128 - DNA, 601 bp, Homo sapiens
  misc_feature (301)..(301): W = A/T
ggctccttgggggaactcttctgaaatagctattgatataccctctatttagatacactgcatttctctccctaaaagctatagctccctaaaagcaagctgtagacttgcattaatggcatccttttcatcttcaaacccacttgtgaatttgtttcttttctctactaggagcagatccctgcttatatcaaaacggaggctgtgaacatatttgcaaaaagaggcttggaactgcttggtgttcgtgtcgtgaaggttttatgaaagcctcagatgggaaaacgtgtctggctctggwtggtcatcagctgttggcaggtaatataataaattatgtggcaaattacctaacgttggctcagaaatacagctgtacatcaatctttatgcttttgctgattttgaatattttggatgttaaaagttctcctgtttttaggaatgctaagaatttgtttgtttatttgttctcttctgctgagttttgagttccttattacaggcaaaattcaattgacctctagtggtaacagtcttaagctccaagccctccacctccccatttatagtggagtgggtcccaggcttggaaataaat

SEQ ID NO: 129 - DNA, 601 bp, Homo sapiens
  misc_feature (301)..(301): K = G/T
atcttccagtctcaggctgtttgttcccccgcggggcaatgcgactgcgcgtcgcttcctgattggccgagagttgcgggctgcgtgcgcaggcgcctacctctgttacttagggcgggagcccggcgagggcgccggtgctttgttctgtctgaggccaggaagtttgaccgcgctgccatgccgaaccgtaaggccagccggaatgcttactatttcttcgtgcaggagaagatccccgaactacggcgacgaggcctgcctgtggctcgcgttgctgatgccatcccttactgctcckcagactgggcggtaaggctggagcggagtgagagggctgggcagggcagttgggcaagccggagggtgaggcgggagggcagaaggcctcgaggaggtcaggcggcttggccctgccagaggaagaggaaggcccccgtttgtggccctgggcaaaccgacaccagaaccacctccctgtaatgccccagcatctgcctgcgggccctagagcacgggatcctcacggctgtttctcttctttgctccttcaatccccaaaagcttctgagggaggaagaaaaggagaaatacgcagaaa

SEQ ID NO: 130 - DNA, 601 bp, Homo sapiens
  misc_feature (301)..(301): N = A/C/G/T
ctcctgagggcaggtggagcgggctcctcggagtttggcctcccccggtcctgcttggccctcccgagcagctggtaatcgggctcttcggatggaggccgagtggagttttggagcgcagcttctccatagctgagcggctccgggcttttacagggctctgtgcagttgacccccaaaggctggtccactgtgttcatgtgttggttggaatggaaaaccaaggctgtggtcttgtgcacccgccccgcgccacatggccgggcctcctccatgggtccagcctcgttcttctctttcncatctgttagaaacccattgttttggcttttaaagggatctgcagctgggaggcttttgaggttcccctttttgcggtccagagggaacgtctggtaacacttcttaaggtcgggcgaggtctgcacgcctgtgctcttggtgacgttggggatggacctgcgtgcgggcactgtcatgtatttgcggtaggctgctctgcaggacacgggcttggcctcccgcttctcccccagctggcccgaggacagctgtgtgtccctctgctcattctgtgcctcgcagatatccttaaaccgca

SEQ ID NO: 131 - DNA, 801 bp, Homo sapiens
  misc_feature (401)..(401): Y = C/T
caaaaagttgctgggcgtgagggcaggaagtgttcaggaccacaggacacgcagactggggctggagggagagggctgagctggagacagacccggggaccctttaggaaaggcctggtgccagtgggcatggaggggaggagcctggatcagaggatcagggactgtccagggttaggaggagagagaagctggaaaagaccctgccacaggtgggaggagggaggaggtgtgggaagaggtgcgaggaggcaggaggtgtgggaagaggtgggaggagggaggaggtgcaagaagaggtggaggagggccctgtggttatcaagggtcatccctattgatggcttctgcccttcgtccctccccagaggggcaatcccgtactgaagttcgtgcgcaaygtgccctgggaatttggcgacgtaattcccgactatgtgctgggccagagcacctgtgccctgttcctcaggtgagctctgcggcgccaccccagacttcaggaagggcaccccactggcctgggagggtcatgtcccagtgttctggactgttctatgagaagcctctgggcatggtcctgcaggttctgggccttggtgggaccctgtgttggaggcagggggtcttggcctggaggtgcccagtgcaacaagagctggagcccgaactcctgggtctcaggaaggaggggctgggggccggactcctgggtccgggggaggaggggctgagggctggactcctggggatctgagggaggaggggctggggcctagactcctgggtctgaggcaggag

SEQ ID NO: 132 - DNA, 701 bp, Homo sapiens
  misc_feature (201)..(201): N = A/C/G/T
ttgcagggagaggctcagggaaatgtgctgggagcctagagggttctgagctcggcaggtgaattccccttcatccttcacatgcactcgaggcagctccagcaccccaaggttcgaggactgtgaggggctcagggtcaggctcccccaggtccagctcagcctggcagggggattgctgtcgacagcacagacaaggtncagggactggccctccaggactgaaagggccgagccattcctcaaggttgtggatgctgtagagaaagagacagaagggcagagagagacaaagtgatcgaggcagggaggaaggatacagaaagagagtggtgaatggaacagacactgatacatgctgaattgtagggacatatgcacgttcactgctcactgttggggatgtaaacttgtccatctttaattagaacaatttcactctatctttcaaaatcagaaagacatatgacactgctatattttgcttttaggactttattccatacacttagatattccttgtgggagtagatacaacaatattcattgcagtgtttgtgctgtaggataaaattagtgccatgatcttccattagaagatgccacaaaatcagagactattcagacagtggaatgacacacagccctagaggagggtgcaaacagtctcactactgacatcaaaccacctctgagatctt

SEQ ID NO: 133 - DNA, 640 bp, Homo sapiens
  misc_feature (207)..(207): R = A/G
tgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccrgaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggaat

SEQ ID NO: 134 - DNA, 601 bp, Homo sapiens
  misc_feature (301)..(301): Y = C/T
gaattaccagattgtagggtgcagtagggaactggtgggagatgagactagacaggaagagagttaagagccatgtaatgaaaggctttgaatgtcctgctaaggagcttgatctttggcctatagacaaatgtgagcaattaagtaggtaagtgatgtgttcagaatttaattttaccctcattacagagaacatggacctaatttctttgttctttcccattactagaatggtaaatcaccaagtttattatatctaatatataaaaatgttttctcaacagaatgaactaaaattgtyggtggtttctttgaaagaaatacaagagagtttgaaaacaaaaattgtggattctccagagaagttaaagaattataaagaaaaaatgaaagatacggtccagaagcttaaaaatgccagagtgagttttctttttattttaatgcttttgtatctaaaaaaaaaaattagcaaattcttgtttaattatgtgttaatttttggatttctgaattatctatacttctcttcctcttaaacttttttgaccttatttctaatctgtagcttttctctagagtgaatatggggaaaataaat

SEQ ID NO: 135 - DNA, 601 bp, Homo sapiens
  misc_feature (301)..(301): Y = C/T
tcacagagaaaactatttattccggagaggagaacatggacattaccaagagtcatacagttgcaatagataatcaaatttttaaacaagatcaatcaaatgtgcaaatagcagctgcaccaacacccgaaaaagaaatgatgctccaaaatcttatgaccacatcagaagatgggaaaatgaatgtaaattgtaactcagttcctcatgtatctaaggaaagaatacagcagagcctgtcaaatcctttgtctatttcattgactgatagaaagactgaactcttatcaggtgaaaatayggatttgactgaaagtcacacaagtaacttaggaagtcaggttcctcttgcagcttataatctagcaccggagagtaccagtgaatctcactctcagagcaaaagctcttcagatgaatgtgaagaaattaccaaaagtcgtaatgaaccatttcagcgatcagacataatagccaaaaacagcttaaccgacacctggaacaaagacaaagattgggttttgaagattttgccctaccttgataaagattctcctcagtcagctgattgtaatcaggagatagcaacaagccataatat

SEQ ID NO: 136 - DNA, 801 bp, Homo sapiens
  misc_feature (401)..(401): R = A/G
tcaaatagcaattaaaaaaaatcacataagaaaagacactcttaataaaatacaaatagaaaatgaaaaaaaaccaactcataaacttggtttaaataatccatttgtattgggtcttagtaagaatactactactagtaactattatcaagcaactactgtgtcatgtacttttcacacattcttttaattaaaaactctccactaacccttacagttcagtattatccttgttttacagatgaagaaaagccaaagagaagttatataactggcaagtttctctggctccccgcctgcaccactgctcaccagattgcatgaagagggaggcagctgtaacacctcatcccgttgatctccagggaactcagatacttgtttccacgtccaggaaaccrcaaactaagctctttgaagcatcagcaaaccttgctaagtgacacgtgaatgccatttggatacatattctaatctttcaagtagaaaggacagtcagactgcctcatctgtaacatccaagggatctgagaacagacattcagtccaggtgttgaacatcaacatcattataggaaaatggtcaaagagaacaatggcacacgttaagagaacatattaatagggcaagatgtatagtaaactaagttttcaagaagtattttatcatttttatgctctctactaaaagctgaccactgtagagtggatacacattgctacatacagcaactctacagtggacagcttttagtagtaagcataaaaatggctttatgttctcatgttctctgtgtagcc

SEQ ID NO: 137 - DNA, 601 bp, Homo sapiens
  misc_feature (301)..(301): W = A/T
ttcacccaagccagcccttttcttgtcaccagccaagaaaggccagaaggaacaaatcagttgccctcttttcaagtttgcatggagaaaagatagcaaccactttcttcccaagcccagttttcttttccctggttccttataagtagaggttgattcgatagtccaactaaagagcaaaagctaggggaaaaactcaccctattccctacctcaagttggaaataaaatgttcatcttcagatgacatgtgtgacaacagaggtgagtatatgttgagtaaggaaagatcctcaggacwcctgaagaagttacttccaaaccaattcatagtgagaagtgttttcttgtcctttgggctatcctttttccctttggcaataagctggtttctaaacttcggattagtccaaagtgaaacatctcttgaaagaatgttcccttaatattctggaacctgaggtcatagcagtgtaactaacagacatcttttttctttaaaaacaggtatacacctaactgtggacacattcatcttactaatctgtagggagatattgctggagtatagagtaaatagaagaaaaagacttatctttgg

SEQ ID NO: 138 - DNA, 801 bp, Homo sapiens
  misc_feature (401)..(401): W = A/T
atggaggaaattcttcccatacttattagaaatatgagttttgagcctacaagaaattctttgggattctgaagctgaggaagcaccgatagacttgtccaattggttactaattttccctttagtctgaaacatgtggagttcaggcagatgcgaatgaaagcttaatccaagctgatctttaataggcttgtttccagcatgcctgtgatcacttcggtctgtactaccagtcaactttttgatttttgtcatgggtgcttcatggccatttctttcaacttcttgccactgaaactcaaagtgatgaatatctttcttcatttctgggaagcaaaaatctccaatgtgatgacttttatgtctttgcaacgtccctgtgtggatcacttctcctgtawtactgtgcctggttgatgagaactccatcatggattttaaagagctatctaaaaaatataaagaccaataggtttccaattaagtacagatggtaaataatagttgatattcagatgtgtaaaaattacacaaaaagcaatacttattttaaacttcccaaatgtgatcttcatagtttaagaacacactgtctctactgaacatacaaaaattagccagtcatggtggtgggtgcctgtaatcccagctactcaggaggctgaggcagcagaattgcttgaagccaggaggcagaggttgcagcatgcggagatcaccacattgcactccagcctgggcaacaagagcaaaattctgtgtagaaaaaaaaaagagttcagtcaagagcctcatatatat

SEQ ID NO: 139 - DNA, 559 bp, Homo sapiens
  misc_feature (301)..(301): R = A/G
ccacattcatcacatttataatgttttcctcgattattaggagacttctcaacttgattgtattcataaattttcccttcacgttgaaattgctgcagttcagggagatgtgactgaaagcttactccaagctgattttcaatatgcctgtttcctgcagcccttctatcacgttgagctcttctaccagggagattttctttttgcaacataagtactgttttataatttccttcatcatctttccactgacactcaaagtcgtatgtatttttctgaacttcctggaaggacaagcctrcagtgtcacagctttcaagtctctccaacttcaccgtgtagaacgcttctcccatattgttcttcccctttggtggcaaatccgtgtttacacatttacaagagatatctgtaagatataaacaaccatagatttccagttaactatagtaggtaaataattatttcccattgaaaaacctaatgttacaccaaaagtaatagttatgttgaacagacttacgattcttcagaaccataattttccagaacacaaaag

SEQ ID NO: 140 - DNA, 501 bp, Homo sapiens
  misc_feature (251)..(251): N = A/C/G/T
gaagctgtctaccatcggtagctggtatccaaaggatgtctcaagaatctttctcctgtttgcatttagaagaccaaaaatgaaagtaaacacttgattaaagtcagagtattgttctctcttctctttatactctctgctgcctgaggggatcagatagttgggtactgccatcagaaatgcaatggctgtacaaaactcctggacgttcaagtgtatgaacttgtaacggtctttatgagtgttgctcngcaaaagaatattcgcggcctgcaacacagagacatcagcctcagtaaacccaacacatctgaggtcttcaccactgaaattcagggtgctcagaaacagtcctcctgcagccagcaaacacagacgttttaggagacctaggtgatactgattggcagtaagtccagcctctgatgtcaacgcatcagcaagaaagtgggcatgtagatcagtgggtgtttggcagcagagctggaagtcacgcccctt

SEQ ID NO: 141 - DNA, 601 bp, Homo sapiens
  misc_feature (301)..(301): R = A/G
taaccaaaatagtgtccagacactgccagctgtcccttgtgggggcaaaatctctcaagttgagaactactgagctgtgtcattgggctgtgaaatcagagaatgagttcatgatggatgatgagagacaaacacaggtgtgcaggctgtgctcccattagatgaaactcatccaaaattttctttgtttttgcagaataaataacgtttccttttctggccagagtgttctgctctttgaggtgctcttttatcagccagacttgaaatacctgagcttcaccctcacgaaactctctcrtgatgacatcaggtccctctgtgatgccttgaactacccagcaggcaacgtcaaagagctagcgtaagtctccgtttattgagaccactgattgggtttcagagaagactatagcctaagtctccgtttattgagaccactgattaggtttcagagaaaactatagcataagtctccgtttattgagaccactgattgggtttcagagaagactatagcgtaagtctccgtttattgagaccactgattgggtttcagagaagactatagcgtaagtctccgtttattgagaccactgat

SEQ ID NO: 142 - DNA, 801 bp, Homo sapiens
  misc_feature (401)..(401): S = C/G
tgggctgagagtgggaaggtgctggtggtgcccactgatggcagccactggctcagcatgcgggaggccttgcgggacctccatgcgagaggccaccaggtggtggtcctcaccctggaggtgaatatgtacatcaaagaagagaactttttcaccctgacaacgtatgccatttcatggacccaggacgaatttgatcgccttttgctgggtcacactcaatcgttctttgaaacagaacatcttctgatgaaattttctagaagaatggcaattatgaacaatatgtctttgatcatacataggtcttgtgtggagctactgcataatgaggccctgatcaggcacctgcatgctacttcctttgatgtggttctaacagacccctttcacctctgcgsggcggtgctggctaagtacctgtcgattcctgctgtgtttttcttgaggaacattccatgtgatttagactttaagggcacacagtgtccaaacccttcctcctatattcctagattactaacgaccaattcagaccacatgacattcctgcaaagggtcaagaacatgctctaccctctggccctgtcctacctttgccatgctgtttctgctccttatgcaagccttgcctctgagctttttcagagagaggtgtcagtggtggatcttgtcagccatgcatctgtgtggctgttccgaggggactttgtgatggattaccccaggccgatcatgcccaacatggtcttcattgggggcatcaactgtgccaacgggaagccactatctcaggtctgt

SEQ ID NO: 143 - DNA, 801 bp, Homo sapiens
  misc_feature (401)..(401): S = C/G
atggagtaagactttattatgtgtgacaactagaaactttcatagtttatgcatatttctatatcaggtagatcattaaatttaaccataagagtagatgttcaaaagaaggcattctatttatctcaacttcccattaattatatcactctccatcatttttatgatatgattttgtgttattgatatttattaaggcatattagtattctgtagaagactgagtatatttattgtactaaagcaaacagatttcacttaactgatgatcacagcacttgaactcaatcttatttaataagaccaagaagtcctggcatttgttttagctttgctttcattggttatacataaaattatgacttacttttaaaatgtgttcttcagctttggcttgcttsgtggcccctccaacaccaggtgaagctgttagtcccagtatctgaggaaggggaatcactggtttgttttctttcttgagtctattgtttttcaacttctgcatcaaataatgcctcatgatgttattatacactgcttctttgttggtgtgatgacattcatcaatgataatgagggaaaagtcttaaaagaaaattcaaagagttcatttctccatatcagcacactacagtgagaaaatagctttagaccagtaattgagctgccttggggatgccttctcttgggcacgacacaagagcagtccactttcagtttttaggagggaaatctaactatactagcacctgtacacacagacgttcgtatatactaatcatgaaactccctgttagacat

SEQ ID NO: 144 - DNA, 601 bp, Homo sapiens
  misc_feature (301)..(301): Y = C/T
gacggttccagctgttaggagaaagtgaaggtgggtgccatggatctgatgatttcagtgattttctactcaagaaaaatgaagtctcggatgggcagagcttaactgccttaaaaacttggtacagggcaaggtgtgagtttcccggtgagactgtgtgaactgtgaacgggtagagtctgaaactacaaaccagatgtttcctggctccctcccgcctggtctggcctgtcttccttcagctgctatgcagttcatcctgggtccctgagggcctcgcagatgcttcactcgaaagatyggagttgcagagtcccctgtggaggaattgaactgccccctctcgcaggaccccagctggcaagggtttgttcctccctggagggtagagaccctcactgaggccctggagaggggcactcaggggcagcagctcattcccaaagttctctggtggagctggggagtggcaccctgggaactctggggtttccccaccagctcctctctccagtctttggtgtccaggtacagtctccaggccgtggcttctcgagttctgtatgtgggttgctgctccgtaatgcatagttgggggacc

SEQ ID NO: 145 - DNA, 801 bp, Homo sapiens
  misc_feature (401)..(401): R = A/G
taaactaagttttcaagaagtattttatcatttttatgctctctactaaaagctgaccactgtagagtggatacacattgctacatacagcaactctacagtggacagcttttagtagtaagcataaaaatggctttatgttctcatgttctctgtgtagccataccacacgttgctacaccaggaacatgagtacatataaccattacatatacatacctgtatgtatgtatattagttacatatacatatgtacagtatatacatgtatatatattgaacccttggaagggatcagcaaagaggaggactcaataaaaaaagactagaatagaactagaagagagagaagcccagggagagcttcaagaagagtgctcaacagggccaaatgcgcagargtcaaatagaaggttaagaagtgcccagtggatttggcaaccagagtcactggtaaccttcaaaagaacaatttcagtagattgttaagggcaaaagccagtttacagtaggttaaggagacaaagggagataaaaattcccaacattccattcattcatctatcccagtgtgtacagagtgattactgtgtgtttgttggcagttgactctaaaaagaaggctagaaatgaggctttttaatttttcccaagtactatgagctctgttggcctacaaaatactcagtgctgtgattcactcatttgtgctttgcatatataatatagtacaaactgctaaagatatttttaaaaaatatattttcacaggggtacaagcgatccatgattatacccact

SEQ ID NO: 146 - DNA, 801 bp, Homo sapiens
  misc_feature (401)..(401): W = A/T
cttttttgtgtgaaacaaatgggtagaaaataacacgtaagtggtgcctttgcattatgaaatgtacttaaaaagcactagctccttttcttctctgatgctatgccagttctttactatttagcatatgccacctatttttatcctgagttttagaagtggctttttctgaaacattaccctgttgtggttgaattagcagatttttttttaatgagtagggtgtgcttctagtgctatcaaaatcctttttattgaatgtaacagtaaagtgtcactagagcagcatatgtttcatagttattcagtgatacatatttttagatgcttagatatttattttcaatgttctttattttttcagaatcagattcattgattcaagagcttgagacatctawtaaggtaatgctttaagttttattttgtcttgataaggtatttaattaacaaaggggtatgaatgatgactagatttgtttattttaaaaaataattaaacagtaatatagtctcttggtatgcatgggggattggttttattctgttattttttctgttcttctttggcttgagtcttcttatttcaacttgtatttatcctttcaaaaagctgaatattttaaaatatgatcagatataaataattcaagatcttggtatctaatatccagtatttaaagaacaaaaatgtacttagaagacattacacctactgtttatacaattcctatcttttcttgtattttttctacttatgaaaatagtagacactagttgtaccaattaccttaagctata

SEQ ID NO: 147 - DNA, 801 bp, Homo sapiens
  misc_feature (401)..(401): S = C/G
tcctggtctgtcttcatctcccaggtatggaggccgtgatgcccttgggcaggagggactggaggtcccccaggaaacaggaattaaggaaaggggtaaaggcaggagggtacacatttaggtccctgagggaaaaggaagaataggcataggggaagcaaagggaactggggactcggggactggagaccactggttgctttatcttccctttccctcaggcctctttgcccggagcatcggtgttgtggaggagaaagtttcccaaaacttggggaccaacttgcctcagctcggacaaccttcctccactggcccctctaactctgaacatccgcagcccgctctggaccctaggtctaatgacttggcaagggttcctctgaagctcagcgtgcctscatcagatggcttcccacctgcaggaggttctgcagtgcagaggtggcctccatcgtgggggctgcctgccatggattcctggccccctgaggatccttggcagatgatggctgctgcggctgaggaccgcctgggggaagcgctgcctgaagaactctcttacctctccagtgctgcggccctcgctccgggcagtggccctttgcctggggagtcttctcccgatgccacaggcctctcacccaaggcttcactcctccaccaggactcggagtccagacgactgccccgttctaattcactgggagccgggggaaaaatcctttcccaacgccctccctggtctctcatccacagggttctgcctgatcacccctggggtaccctgaatcccagtgt

SEQ ID NO: 148 - DNA, 503 bp, Homo sapiens
  misc_feature (251)..(251): M = A/C
cgctaatagccttatattctttccctggagtgaaagaaaactctatattttactatacttacccatttcaattttacaagcaagaatgctgtgctggtgaaaataaactgcttcttcaataactttaaaggtttgaatatcccagaagccgtcagtacttaaaccagccaaaaacttctcattttttatagttggtcttcctgctctccaatgtgtatatgacagtggggtcttatcaaaccacataagagamttatctagagaagaaacattttttcctatgcttagagattaaatcaagacttgaattacacttatacagttaagatttcaaacttgactaattttctcttttcccaaccttctaaaaggttgtatgattatgtataaccctttaagatattttctgattataacagtaaatcatgctcatttttaatttgaatataaatacaaactataaatattgacctataattccaccatccttcagtaataacatt

SEQ ID NO: 149 - DNA, 877 bp, Homo sapiens
  misc_feature (377)..(377): M = A/C
cgtaaactgaacgtgttcttttgtgctcttttataacttgcattacatgttgtaagcatggtccgttctatacctttttctggtcataatgaacactcattttgttagcgagggtggtaaagtgaacaaaaaggggaagtatcaaactactgccatttcagtgagaaaatcctaggtgctactttataataagacatttgttaggccattcttgcattgatataaagaaatacctgagactgggtgatttatatgaaaagaggtttaattggctcacagttctgcaggctgtatgggaagcatggcggcatctgcttctggggacacctcaggagctttactcatggcagaaggcaaagcaaaggcaggcacttcamacagtaaaagcaggagcgagagagaggtgccacactgaaacagccagatctcatgagaagtcactcactattgcaaggacagcatcaaagagatggtgctaaaccattcatgatgaactcacccccatgatccaatcacctcccaccaggctccacctcgaatactggggattaccattcagcatgagatttgggcaggaacacagacccaaaccataccacacacattatcattgttaaactttgtaaagtatttaaggtacatggaacacacgggaagtctggtagctcagcccatttctttattgcatctgttattcaccatgtaattcaggtaccacgtattccagggagcctttcttggccctcagtttgcagtatacacactttccaagtactcttgtagcatcctgtttgtatcatagcactggtcacattgccttacctaaatctgtttgacagtctgctcaacacgactgcaagctccatgagggcaggga

SEQ ID NO: 150 - DNA, 601 bp, Homo sapiens
  misc_feature (301)..(301): Y = C/T
tgaaagcataattggagctgttgagagagatggtcagtgagaagggacactctccatggcagtaatttgccatgaaccccttgggggcaatgatccacttgtgccaacccaggtcccggaagttaatgaatagctggtgacggtggcagaggttcttacaagaaagcttggggacagggatggctgctctccttttccgagaagggtggcactgatcagggttgagagtcaccaccagcagggaagcatgaagggagcatcttagtctggcacaggtgtcttcaggctgaaaattcacccytgagtctctatcttctttgaccagtatctccaggaataacccgaaatttttccgggggttgtcattccaatccttagctacatccagcaggttgaagtgaacagcaccttgtggccatgggactgaccgcaacacaaacattttacctggcttaggggtggtctggccccacacatgaggctcctgaaccaggaacagagccagttccagctctggtcccaggttatagtaagaattgggccccaagtccaggcccagctgggccaatgtcaactgttccctttctttgatggcagacag

SEQ ID NO: 151 - DNA, 801 bp, Homo sapiens
  misc_feature (401)..(401): Y = C/T
aatgatatacacatttgatgttgaatcctcctgtatgtagctctctctagggagatcatgttccacgatctcagccagactttaggtcctgtgagtccaggcactggactcaacatgctcaatagggctttgatgaatgatgatgatgtcaatgcagacatccccataccccagcttcagcacccccttcacctccccacacggaagcagaggggtcctcttttccttctcctggctatgtttatgccctcaactatccttccagcactggagacaagtctcacctgcactaacctgtctttgaaggtcctgggggctggaggggtcacaggccctgagccagcaggctgaggtgatcgttcggcagctgcaagagctgcggcggctggaggaggaggtcyggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggagccagcgggagctggaagaggttcagaggctgcaccaagagcaggtgaatgcaggggtagaaaggattcaaattcataacggagagctgggcagtagcttccaagcaaagaacaggtattgcagaaaagaccctccatgagtagtgagtagtagagtgatgagacctttggtgaaaataaacacacatggcctagaaagatggagaatttgggtacttttatcttaattcaggtt

SEQ ID NO: 152 - DNA, 601 bp, Homo sapiens
  misc_feature (301)..(301): M = A/C
gtcccatgaaagaaataggcatgtaaaggacaaggtggtgcagactaactgcaagaactgggctgttactaaaacaggtgccaagaaccatggttccagcgtcccaggccataagattcccagtgacagggacctggtttcccaaggagcctcacagctcacatcattggagataaacttttcaaccagcattaagaatgcctgccaaaaatatcaagcccaaagtatgtttttgtgtgacccacgtgaacatttggtgattaaacagaaagatgggactgtagaaatgcgggggaaagamaagaagcagcagcccaggaaggcccacagggcccacagaggcaggctcatagccagcaagcaaaaacaaatcccaatccagacctgtaaattcaattccaaatatcagagtcctcagcctgcaatttctgtccctcaaagccccttcctggggcagcaggaaccccgtgctcagcctctgcatctgcagtgtcccaggagccccagaaaaccagtctgccctattctgggaggaacagtcatgcccaataagacagtaagggcagtgcagggaagactcttgcagctcagcaggtgctct

SEQ ID NO: 153 - DNA, 601 bp, Homo sapiens
  misc_feature (301)..(301): R = A/G
aaaccgcctccttcaggctcaccttgacatatgagcaggatgcagtagaaaatcatgaagcagcgaatgttattgcaacactcacagcaggtgctgactaagcagcccaaaccacagggctgctccaaactgtcatccacttctcccggcttcttggaaactgaggacttggcttttttcctttttcggaaaccgccgaaccttatcaaggcctctggaagtagtctcagataccggtgttttttcccgggcttcgaggacttcggggttcccttggccctcctgtccttagcaggctggrcccgcgcggcctccagcggctctactccccttgagacttcatcctggctcccagagtgccgggcgacgcctacgaacatggctcaccctgggcggctcctggcgacgcggcccgagtgctctcggctgcccgtcctgcctgggccaacccaaaggccagcctggcgagggcgtcggaggactcggtggccacaaggggctcttgccgcccaagcctccagagcgaacgtttctcctagggcaggaggcaaacgtcctcccgggggttgacggttgagaacttccaaagctgttttccttc

SEQ ID NO: 154 - DNA, 578 bp, Homo sapiens
  misc_feature (201)..(201): Y = C/T
gagagagcatcttgaacactcctggcaaggggctcctggtgagcggggatgttggcagaaatggtcatatccattaatagaaactcgacagaggtagcacatctgggcaccacagcggcaagacatgcggttgcagccttcagatttgatgaggccagtcccacacttgtggcattttctaatgcgggcagcagtcatttyttcttcactgaaataagaaaacataatttggagctgggagggaagatgaggaggaaaaaaatatggccattaagcatttatttattttcacataaaatgatcacttatggcttttttgtgacattaaacagtgaaaagagcctaggttttggagtctgagaactgcttcaaagttttaattgtatgaccttcagtaaattactcacctgcctggagactcagtttcctcatttttaaactgtgaaaacacaactttctcatggtgttttgagaattacagacaaaatataaagtaccctggcatagtgcccagtactcagcatttagaaaaggactgctctatttgttataggaatccctgtaggcttaaaatggag

SEQ ID NO: 155 - DNA, 501 bp, Homo sapiens
  misc_feature (251)..(251): V = A/C/G
tctgtctgtgggaatagggtgggagggggcagggcagagagtgccctgtgcccccgccctcagccagcacctacctgagcagatgcctttcaggtaaggaaggactttcttccacagtaaagacttgcaaacaaacacagccacaatcaagactacggctgcaactgtgactcctatgatgatgcctgagagagaacagggagaggcaggagtccctgggctggaggtcaccgtctcctccacagctgggvcttccccactgtgctttgtacctgattctttgtggacacattcgatgtcactccagggtgtacaatcaccgaccttgaccatccctctgggacacctgggtacacacacggagggagaggggggactcttgatggaaagctggccaggtgggatgaaagaggagccaccctccctccccagtgtccctgagaaggtgtcaggggaaggatagtctcctcgtgtcagcagtgggtccccctgtgctccctt

SEQ ID NO: 156 - DNA, 601 bp, Homo sapiens
  misc_feature (301)..(301): Y = C/T
caatgtctgagtcagatgaggcagattctagtattttcatcagactctaaacatgccagaattatggggtctgaattttacttttttcttgctttcctagggagcagctatgcattgggaagcaatgcagaagacaaaccaattaaaaaacaacttggagtatcctttcacttacatctgtctgaactggagctatttccagatgaaagggtaataaatggatgtaatcaagttgaaaactttatcaaccacagttcctctgtttcctgtcttcaagaaatgtcttccagtgtcaaaaccyccatttttaataggaatgattttgatgattcttcatttctcccacaagaacagaaagtacaccttagagaaaaaccttatgaatgtaatgagcatagcaaagtctttagagtatcttccagccttactaaacatcaagtaatccatactgtagagaaaccttacaaatgtaattcatgcggcaaggtctttagtcgcaattcgcaccttgcagaacattgtagaattcatactggagagaaaccttacaaatgtaatgtctgtggcaaggtttttagttacaattcaaactttgcacgac

SEQ ID NO: 157 - DNA, 601 bp, Homo sapiens
  misc_feature (301)..(301): R = A/G
ctaggggtttcctcagagtccactaagaaggtaagtgacatagggagtggcagagcctccaggaacattccctacttcaaccagaatagttgtgcttttaagttctagtacaatgttgtttgggctaagtaaaaagttttaaaaccataggcctagactttaaggtccctttcaaccttgagtttatgattataatacagaatttacacaaatgttaatgggagctatgaaaaatcttcagaattgagtcaaacatttgttattattgttctttataactcttgaaatacacttacacttrtataatgctcctgttcatcttctacatctttgtccctcaggattttttgaaatggtgtttttatttgttttggtgatagtatagttgagtcaatattttccattcgttctctctcagtggtcacttttactttgaagatgtgaaaaggtgttgagacttctcccacatttaaatacataggttccccttcaaatataactccttcacaatcaccatccttaaaaccgggaggctggtaatctgggggtgtaactgcaaaaaagtaagtgtaaactgtgctgttcatgaaattaaagaaaa

SEQ ID NO: 158 - DNA, 801 bp, Homo sapiens
  misc_feature (401)..(401): Y = C/T
ttttatggtttttttttcaaaaatagaaactcatattctttccttcttaatttagtttctttcaggacattctcatgagactggtgaaatataactgcgaagtagcatgataactgtgaaatagcatgatcattgtgaaagctatatgacccaaaacttccataggaataagtgcaatgcttgcatatctgaaacctgctgttacatctctttgcacttaataaatatgtgttgactgattcattctcctgggtggtgctgagaaagtaaaaatcatggctgataaaaattctgtttatggttttgtctaacttatttttcagttgagatataggctactcttcccaactcagtcttgaagagtatcaccaactgcctcatgtgtggtgaccttcactgtygtatgccagtgactcatctggagtaatctcaacaacgagttaccaatacttgctcttgattgataaacagaatggggttttggatcttagcaattctcacaattctcatgtattccacagcagcaaagtttagtaagtattgccttctaagtataatttaaatttttataaattaaataatttcaagaacatttaccttgttttaagcagtttgcttccagttgttccagttgaattgtaaactgaaaaatatattgcttttgtacaatcatttttcattacaaatctatcagaagaaattctttgtaatgaatatatcatcagtttggctttgcatattcaaatgcagcagaatttaatgtggtgcctgcacatgggaagtgttgtggatgtttattga

SEQ ID NO: 159 - DNA, 801 bp, Homo sapiens
  misc_feature (401)..(401): R = A/G
ttttatctttcaaggtcctaggaatacaggagaacgtggatcttgttggaatagttccccagcctggctgaggaaggccatccatctgaccacaaggactggcatctgtgctggcctttagttgaattgacactttcagcaggacctgtctgtgtctcagtatatgtgcatttacctatgccttcactacacctttaagaattcatttcaggggcccacacatgtgacagtaattgactttagcactatgaaatactttatgataataccataaaacaaattaatattatattttgctaaggtattccatgcagaaagaattgtaagaaagaggaactgggaagaagctgaacgattctgccaagcccttggagcacacctttctagcttcagccatgtgratgaaataaaggaatttcttcactttttaacggaccagttcaggtaatactttaagaatgagaatttctatgctgaatttgatgtcctctagatattcaaaattgacatgttcttaccctcactctctgttggaaaaaaaatggacatgttttattatctaaaaggtcatttggtgcttagcagtcatggaacattaagcactcttaatgtgcagacactatgaggaatctaaaaatgaatgagatgtattccctaccctttgtttaataaagtccaacagcaatgtatggcagaaaatctagaatataggcaaggaagggccttgggaattcagaggagggagggagtgtttctgggagtataatcaggaaaaatgtcataaagaaggctgattcttgg

SEQ ID NO: 160 - DNA, 801 bp, Homo sapiens
  misc_feature (401)..(401): R = A/G
ctgtaagggttgatattaaacagaaagaggcactgataggaatgtggtctggtgatgcttattttacagcggtggagtattgaaaaactccaaaaatttgtctccaatattgctttgccctgaaaaaactgtcatacgtaaaggggctattacatctacgtctgtagatcgacttgtgctaaggagaccccaatcctttgtagattgataagctatgattgtgaaatctttcccttaaataagcttttataaaatttaaaataacttggaaaacacatttttagaatgaagtgacttactcaaggccattgatgatgttgaaagtattgcaaacaaagattaaaaaccactcgacaacatttatgtacaccatagtataccatcacaaagcctctcattaractttgaatccaatgagtattactaaagattaagctcttttttaatttgcagaaactctgacaccaaactagaaaaaaaaaaaaaaagctggttttgctctccaaatagttgtattgccattcaaaaaaagtaagttaagttagcattcagattgctttatctttggaaaattaagtcacaaaaaaagaataaagaacagatgtggctttgaattagtaatgtaatttccccctgaaatttcttaaatcttgatagtgtgttcagaaaacctctttgcgtcatagttcagaatgtataagataagatggagcaggaggaagtaaagggaggagggagaagtgcaagaaacccaaccagaagggcaccgctgttcccacttcgacttctttcacgtagtat

SEQ ID NO: 161 - DNA, 601 bp, Homo sapiens
  misc_feature (301)..(301): M = A/C
tttgggttaagcagtgttctttttagcaaacagccctgggaggaagaacatatggtcactaacatcttaatattgagtttattagataaagacaagaaaaaatggggcttggggaaattggggcttctggggttttaaggagcatgctgaaagaacgtaagaaacaaaacatgaagggaaatggaaatgttaccctcactcccctcctccctgctgtccagtgtggatgccacctccagcctgcaggacggagccccctcccatcatcacacagtgcacctgggctctgcagccccttgcmtccattgcagccgcagcaagaggcctccacttgtccgtcagggacgctccaaggaaggaaaaagccgcccccggacaggggagaccactgtgttctctgtgggcaggtggggcaggtgctccagggaaaggggggctgaggtagggggcccagtgatcaggcacctgatcccaaaagtgggccttggctctttcctcctggactgggagctccggcagaagtcaggctacacaatgtgccccacaatctgagaaggcctcccctaccttaggccagagggaagtagccaccaaactcagg

SEQ ID NO: 162 - DNA, 606 bp, Homo sapiens
  misc_feature (324)..(324): R = A/G
ctttgtgaattgtgtcaatacccctgttttatcacatgttacaggaacttcaaaatgagggtccttcaccacagtaatattcaaagttgtgggtgaggcatagtttttgccatctgaggctgtaatcttcagggaataactggtgggttgaccagcagtaagattgataaaagggcgtttgagggatatcactccggagaaatgatttagatcaaaatactctagttcattgcctgatacaatctcgtattttaggttctgaagctcatccacatctatggctgacatagtcattatcgatttccctactggccagtcttggcrgatagaccctgtacagttgacttcttcaaacataggctggttgtcattcaagttcctgagctgaagaaaaatggacacttccttctcccggcgaaaaggggatccccagtctgatgctcttacccggaaggtataaattcttttcatgagttcatagtccatgggtttggaggtggagatgatccccaggtaggggtcaatagaaaatggcaaagcttttggtccagcaatggaataggtgacatatccattttccccatgatcccggtcagtggcagtcac

SEQ ID NO: 163 - DNA, 701 bp, Homo sapiens
  misc_feature (201)..(201): Y = C/T
gaaatgcactactaggccaacaaaatagaaaacattcataagtttttattttattaatgtagttgaactacataccgtccatttgttttcatccttttcctggcggtaagctacatcgtgcattaaaacttttacatacttcttttgcaagtgtgatgtattaaatgtcaccacaaagtcattggctccttcccgatagaygacactcaggtcaaaaggagcctcaggtttaactggaaaagaaaaagaaataaattctgtctaaagggcagccaaggaaataattatagtatttaaaattcatctcctctgcaagtcactttgaccctttttgtgtcagtaaatggccaactattcagaaaaccatttcttcttcttgggtttaaatccagtccgcattctccagcctctcttgcagtggggtgtggccttgtgagtgaggtgggcagaagaaatgcacatccacttccaccctgggccagacacacacccatgtgtgactcctctgctccgtcctcttccaccacttggagtcctgcattacagacggtggagccacaagatggaaagtgcccctaatactgctgggagaagccccagctgcaggttagaaacatccattttgactctgatgtgagtgagaaataaacctacggtgtttgagatatcatatgtttgggggcttatttgttacagcagct

SEQ ID NO: 164 - DNA, 605 bp, Homo sapiens
  misc_feature (237)..(237): R = A/G
gagtctcagggtctgaaagctgaaccgtgagaggagatttgtatgagtgtttttggtgaaggacaaggagtttcaggaggcctttgggaattccttagatgttaacatttgttaattaggccacatattctttcttttgtggctattaaaaagagcatatgaaaagagagacagaggatgtctaagcaaccattaaaaccaccatccctcaccatatttcaaattccagattggtgrtgttgacatctgggtcctcaaaagcacaggtcagtgagtgctgcgatccattcacttccaactggctatagcatgagaatgagtagtcatccagttctgcatcttccaagtctcctggggaggaacaaacatgcagctgttaatgaaacaaataaatgcatccttttgaaatatggcatgaccttaataaaatagcagactctgtggcagacatgaaatagtaatggattatgtagtattcaaggaagaaaagcccaagggcaaagacaagaaaaatgcttcaaaaccaaccaaccaacaaaaaacaaaaaacaaaaacgctcaatgctaacagagttttccaatagaaaaaaaaaatccatcataat

SEQ ID NO: 165 - DNA, 681 bp, Homo sapiens
  misc_feature (64)..(64): R = A/G
caggagacattatgggcacagccctgcagaacctggatggtctggtgcagatgcccagtggctrtggcgagcagaacatggtcttgtttgctcccatcatctatgtcttgcagtacctggagaaggcagggctgctgacggaggagatcaggtctcgggcagtgggtttcctggaaataggtaagttggttcagtctttctttcttgaacactctcctccactaggccctatgacagattgatgatacagggaattccagcccctcaagtgtcccatatccttgaacggcatgggggtgttttctgaagttgtcgctgtgatctaaaaccacatttggcttcccagggtaccagaaggagctgatgtacaaacacagcaatggctcatacagtgcctttggggagcgagatggaaatggaaacacatggtaatatcacccaattcccaatgagttctgtactccagagcataattcctgagccctctggaactattccactacctctccccttaacccctttccttcttgcactcagtcttctacctctttaatactgtttatttcaccctcatggatggtcaagtccctcgatcttcctgagcttgtgcctcccctgttcttgtcctcattggtgcccattaatgcctctcttttctaggcctgctatggcatatgttcc

SEQ ID NO: 166 - DNA, 1114 bp, Homo sapiens
  misc_feature (201)..(201): R = A/G
ggcagcatcttaacatctaactacttaggacacccaccctgtttacaggcagaaataaaggatttttaaaacaaagcaaatctgtgaaagaaccaactgaattaaatcgagaagtctaggcagagaggagagagagaaggggtccgtgtacctcatacgctgtgcaccagaatggaccctgcagaacctacctgctaccgrggaaggtggttctgttggtaaccggctgggggtcacagaggttcctgggaaatcagaaaatgagataaatctgtgctctgtcgctgtgggtcctgaacaaataacgaaacatctccgtgactgagtttcctcaccggaaaaatgagcctaaagtagcttacatcactggactgttgtggatgttaataagcatttgagctgggtgcagtgcctcatgcctgtaatcccagcactttgggaggctgaggagggcagatcacttgaggtcaggagttcaagcccagcctggccagtatggtgaaaccccgtctccactaaaaatacaaaaattagccaggcgtggtggtgtgcacctgtaatcccagctgctcgggaggctgaggcaggagaatcacttgaacctaggaggcagaggttgcagtgatctgagatcgcaccactgcactccagcctgggtgacgcagtaagactccatctgaaaaaaaaaggcttagccaggcgtggtggctcacacctgtaatcccagcactttgagaggccgaggcaggcagatcacctgaggtcaagagttcaagaccagcctggccaacatggtgaaaccctgtctctacgaaaaatacaaaaattagctgggcatgatggcaggtgcctgtaatcccatctactcaggaggctgaggcaggagaatcgcttaaacccaggaggtggaggttgcagtgaactgagatcactccactgcactccagcctgggtgacaaagtgagactccccccaaaaaaaaaaaaaaaaaaaaaagcagcagcatttgtaaagcacacctggcacattctgggctattaacaaggaaatgcatgcagctcccgtccacctttttcaacctcagttctatttcttctggattcctgtgtcctac

SEQ ID NO: 167 - DNA, 801 bp, Homo sapiens
  misc_feature (401)..(401): Y = C/T
tatcaacattttgaagcctcaatttcttcatctcagctggtgataataatagcatctatgttatagcaccatagtgagcattaaataaaattatgtaatgaatttagccaagcaataagcagaaagtatatacacacaatatatatttgtcattatatgatttcttcagcaacaaattccaatgagactagcacctctgccaacactggatccagtgtgatctccagtggagccagcacagccaccaactctgggtccagtgtgacctccagtggggtcagcacagccaccatctcagggtccagcgtgacctccaatggggtcagcatagtcaccaactctgagttccatacaacctccagtgggatcagcacagccaccaactctgagttcagcacagygtccagtgggatcagcatagccaccaactctgagtccagcacaacctccagtggggccagcacagccaccaactctgagtccagcacaccctccagtggggccagcacagccaccaactctgactccagcacaacctccagtggggctagcacagccaccaactctgactccagcacaacctccagtgaggccagcacagccaccaactctgagtccagcacaacctccagtggggccagcacagccaccaactctgagtccagcacagtgtccagtagggccagcactgccaccaactctgagtccagcacaacctccagtggggccagcacagccaccaactctgagtccagaacgacctccaatggggctggcacagccaccaactctgagtccagc

SEQ ID NO: 168 - DNA, 601 bp, Homo sapiens
  misc_feature (301)..(301): N = A/C/G/T
aagcacatgcctccagaggtgctggacaccttcagtattgatgccaagacaggccaggtcattctgcgtcgacctctagactatgaaaagaaccctgcctacgaggtggatgttcaggcaagggacctgggtcccaatcctatcccagcccattgcaaagttctcatcaaggttctggatgtcaatgacaacatcccaagcatccacgtcacatgggcctcccagccatcactggtgtcagaagctcttcccaaggacagttttattgctcttgtcatggcagatgacttggattcagganacaatggtttggtccactgctggctgagccaagagctgggccacttcaggctgaaaagaactaatggcaacacatacatgttgctaaccaatgccacactggacagagagcagtggcccaaatataccctcactctgttagcccaagaccaaggactccagcccttatcagccaagaaacagctcagcattcagatcagtgacatcaacgacaatgcacctgtgtttgagaaaagcaggtatgaagtctccacgcgggaaaacaacttaccctctcttcacctcattaccatcaaggctc

SEQ ID NO: 169 - DNA, 601 bp, Homo sapiens
  misc_feature (301)..(301): N = A/C/G/T
gcgggcaacccatgcttgcatccagtgtctctgtgtgggtcagcctcttggatgccaatgataatgccccagaggtggtccagcctgtgctcagcgatggaaaagccagcctctccgtgcttgtgaatgcctccacaggccacctgctggtgcccatcgagactcccaatggcttgggcccagcgggcactgacacacctccactggccactcacagctcccggccattccttttgacaaccattgtggcaagagatgcagactcgggggcaaatggagagcccctctacagcatccgcantggaaatgaagcccacctcttcatcctcaaccctcatacggggcagctgttcgtcaatgtcaccaatgccagcagcctcattgggagtgagtgggagctggagatagtagtagaggaccagggaagcccccccttacagacccgagccctgttgagggtcatgtttgtcaccagtgtggaccacctgagggactcagcccgcaagcctggggctttgagcatgtcgatgctgacggtgatctgcctggctgtactgctgggcatcttcgggttgatcctggctttgttcatgtccatctg

SEQ ID NO: 170 - DNA, 801 bp, Homo sapiens
  misc_feature (401)..(401): N = A/C/G/T
atgtgctgtgtccaggtgcctacagtctgtgtgcgtccgagcatgggctctacctggacacagtgaggagcgagattaaatacctggatcacagccgagtccaaagcctaggacttcatcctgggagcagtgcgtagggatggcggtcgtcccgccacagccttggctccgccatctttgaaatggccccatcacccaaaacgctcctccttctgaaccccagagctccactctgcacccatgctctagcctcacaccaaggactttcttggtaagagacggacagttcggtgaagtgattaaaagcctacaggcttagataatggaagagagagctccgtcctcacactcctttctgctgagcatgaaatgcctggttactcaccagttgtgaagacttngtttgtgaatgagacggtcagttcagcggtggcttctgagaattctaagaaagcaaaacaatgttaggtcttccccgtggttccctatatcctctagatatctccattccccttttgagatatctaggctccctgaaacccctttctctgacacactgcacagacactgaagacagacaaattcgaaaggtgtaagacttatcttccatgaccggcttagtaagaagcagatccgttcagcaattgatagacacttggttttttttccacgttttgctgttatgaatattgctgctgtgaacattgacgtacaggtttttgtgtgaacataagttttctgttctcttgggtacacacccaggggtggtggaatcactgggtcatacagtaactctgtgtt

SEQ ID NO: 171 - DNA, 602 bp, Homo sapiens
  misc_feature (201)..(201): R = A/G
gattttgcaattagggctaaaggattgtgggtctgtgctccatttgatagtaatctctttcccttagatgggaagagacagaaatgatcctcatagaatatttatagtccaaattctgtcaacagtgtaagcagtcataagatttatagatcttttagttagatattattgatttggttttcctttactttctagctcctrtgacttctagaagtacatctacttggagaatacccagcaggaagagacgtaagagcaattaaaaactcttgatgtaacaaatgtctttatttgctgcaaaagctacattcactttttatgttatatcctttaaaataaaaaattaatttgttgggattttagatgatttgcattttacattttcaattagatgagttgggctggtataaaacataagcctcaaaatgttcaaaggcacaagtgcaacataagtttatttttcactcacataaataggataaagtagttcctgagtagagggggtgcccacacagtcattcagggcccagctgatgggggctctgacatctttaagatgttgcttccatggttcccttggataagaaactgagatggaagca

SEQ ID NO: 172 - DNA, 1046 bp, Homo sapiens
  misc_feature (845)..(845): S = C/G
tttgagatgtgaagttaaacctaaaatcttgatgagtttaaagtttaattatttttttggcaagaatacttcatagacaatgctgtatacctcacattgtctcacatacgaaagtatgtaatgtttgattgtcttattttggtgatgcttatctaaggtcgatttgtttgtttcaaactgaaattaaacatttccattcaaccaaaatcaaaactgtaaaaccaagtgcattcagagaagtctcacatttatccctgctcttctatctggtctcttccctcttcttaaaggcaatcagtttttgggtttttgcatggtttgttttaacaaatataagaaaattcacacacacctttcttacacaaaaggcatactctgtacattatactacatactgtatactatatacactacatatattgttctgcattttgcttttttcaccttgaaatatatcccagatrtcactccatatcaatatatggagggttttttttatttttttcagttttagaggattccattttgtgaatgtaccatgttttgttcaagtagtcctatattgatgaatagtctggttattgtcaattttgctattacaaaaaaagtactacagttaacaatgtgcattcatcatcttgtttttggcaagtgtatatttggtaaagattactagaagtacgattgccgctcggaaggtaaaacatatataattttgctagatagtctataaaattattaagtctaatattaatttactttgtttctcccatcagaaagaagccaacaaaacatataactgtgaaaatttaggtctcagtgaaatccctgacactctaccaaasacaacagaatttttggaattcagctttaattttttgcctacaattcacaatagaaccttcagcagactcatgaatcttacctttttggatttaactaggtatgtatctgagttatttgtgtgctcttttattttatttaagttaaaatacagtatgtgcttaatttatttgcaggacctttttggggggcccagggacaat

SEQ ID NO: 173 - DNA, 863 bp, Homo sapiens
  misc_feature (75)..(75): Y = C/T
tgggaatgtttttttgttagtgatgatgtcatgccttgtgcaaaatctgtattagcatctcacaacataagattyggctctattctaacggcattttccaccactcgatgtccaccgtaatacttggctctcgaagaatcactgggctggctccctcacttcatgcaggtctattctattatcacttactcagagatttctctggccttttcttcacagcacttacaaaatgcgatctattacatattaatttgcttwtttgcttcttgttttcctatactcccatccctcccagaagctccaagagagcatactgttktatccctagggcctagaataatgcgtccacgtagtaggtactcaaaattttttgcttgacaggctagaaaaggtgaataaacacaaagcgggagcgaaaagtctacttctaggtcaggcactctttggacttcacgcaacgtgtgagcgccacctctcgggaagccaatttgctcgcgaacgaaggaagtgagtcagagaacccgggggtggagagaagaaagcaagcagctaaccggaaaggtctgaaaaagctagcgccggaagttaaactgcagaaagttgttccctagaatgactgcctactcccaagaggaagcgtgggcgagcggtgttctgcaaaatgggytctccggcagcggatctgcgcagaagcgttccgtgcgtgcaagtgctgcgaaccacgtgggtcccgggcgcgtttcgggtgctggcggctgcagccggagttcaaacctaagcagctggaagggtaagaggtgttcgggatcctgagaggaaaaagaaaggagtgtagtcgcgggagtgggttaggtgaggagtta

SEQ ID NO: 174 - DNA, 643 bp, Homo sapiens
  misc_feature (369)..(369): R = A/G
ccccgcagccctctggagtggaggaaactgagacccactgaggttacgtagtttgcccaaggtcaagcctgggtgcctgcaatccttgccctgtgccaggctgcctcccaggtgtcaggtgagctctgagcacctgctgtgtggcagtctctcatccttccacgcacatcctcttcccctcctcccaggctggggctcacagacagccccctggttggcccatccccagtgactgtgtgttgatcaggcgcccagtcacgcggcctgctcccctccacccaaccccagggctctatgggaaggaccagcaggaggcagccctggtggacatggtgaatgacggcgtggaggacctccgctgcaaatacrtctccctcatctacaccaactatgtgagcatctgcaccagggttgggcactgggggctgaacaaagaaaggggcttcttgtgccctcaccccccttacccctcaggtggcttgggctgaccccttcttgggtcagggtgcaggggctgggtcagctctgggccaggggcccaggggcctgggacaagacacaacctgcacccttattgcctgggacatcaaccagccaagtaacgggtcatgggggcgagtgcaaggacagagacctccagcaa

SEQ ID NO: 175 - DNA, 401 bp, Homo sapiens
  misc_feature (201)..(201): R = A/G
actgtgttataacactgcacaaagatcaagatctgattaaggatccacgaaatctattggctaatcaaactttagtatatagtcaagatctgggggagatgactaaacttaattcaaagcgagtatcttttaagcttccaaaggatcaaatgaaagtctatgttgatgacatttatgttattcctcagcctcatttctcarccgaccaacctccattacctaaaaaaggacagagtagtatcaataaagaagaagtaatactgtctaaagctggaaataagagtttaaatattatagaaaattcctctgcacccatatgtgaaaacaagcccaaaatactcaatagtgaggaatggtttgctgcagcctgtaaaaaagaactgaaggaaaatattcaaaca

SEQ ID NO: 176 - DNA, 501 bp, Homo sapiens
  misc_feature (251)..(251): Y = C/T
ttcccaccaaaggcttttatagtctgccacattcataggatttttctcagtatacaatttttagacataatgtcctaaaatattttctcaaatgttttgtacatgttttctctgacacaaaacatgaagtaactgatcactaaataaacaaccatgtagtctgcattcatgaaattactcttctttgcagatatcttaagggcctacatctggcaagaggctttcccaaaatgactacctgtgaattctcytgtgtttaacaaggatagacaagtgcgcaaaagctttcccacaatcactacatccatagggcctctctcctgtatgttttctttgatgaacattgagccctgattttgtagtgaaggctttcccgcagtcactgcatttgtacggtttctctcctgtgtgaattctctgatgtgtaataagatcatttttgcgcaaagagaattttccacattcagtacatgcaaaggaagtctttcctgtgtgaaatcg

SEQ ID NO: 177 - DNA, 501 bp, Homo sapiens
  misc_feature (251)..(251): R = A/G
cgaaaaggaaaatgagctcccgtttcagggctctggggttgggatggaatggaacacaaccaccaaccattcatctccttgaattgtgtctccagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggrgccaacagatgtgtcagccaggattgacctttgcacgaacaccaagtgtctgcaagtaaacacctggaggtgaaggcagagaggagccaggactgtggagtccgacaaagctacttgaaggacacaagagagaaaagctcactaagaagcttgaatctacttttttttttttttgagacagagtctggctctgtcacccaggctggagtgcagtggagcaatctcggctcattgaacctcttgggttcaa

SEQ ID NO: 178 - DNA, 501 bp, Homo sapiens
  misc_feature (251)..(251): N = A/C/G/T
gcttggaaagccctgtctgctaagaaacgacacccactaggaacgggacctacaggtttaagctccggccggtgaggctggagaggcccatgggtactcttcatctcccaaggagctcccaaagtcctttcatctttttccttcccccatcctaatagggctgggttcagaaccgactgtgtctcaccagtggctgcagtgagggtgctgttatagcctctgacctcattcctctcggcccagacggtgangtggtacaggctgccagcttccagttcctttagggtgatgtcagtacctgaggtgctttgggtcctggggtcagtcatgccttccctgacccatgagacccagtagctgtaggaagactggcctgggccctggggagctgtccagcgcaaagcaatggtgctgttggtccagtcctgcttgctgaggcttgtcactgcgttggggactgggagagggagcagagtcaggatttccacatcccctagtcct

SEQ ID NO: 179 - DNA, 801 bp, Homo sapiens
  misc_feature (401)..(401): S = C/G
gtggtgcgatctcagctcactgcaacctctgcctcccgggttcaagcgattctcctgcctcagcctcctgagtagctgagactacagatgcgtgccactatgcccggctaatttttgtatttctaatagagacggagtttcgccatgttggccaggctggtctcaaactcctgacctcaggtgatccacccacctcagcctcccaaagtgctgggattacaggcataagccaccacgcctaggcaactgcttctcttcttaaaggtggaattgactatatacctagggactgcttgcttcctgttgcccagccaggtcagcaatcctctgctcattggccatggggctctgtctactctggggttgctgctgttggacttggctggggctgtccagaaaascgaggatgcaggactggagctggtaggtgaagatgtcaggtgaaattctgggagatgtttcttgatactctggaatgcaggtaacctcttccttcttacacctgaccccccaatttgtctttgcagctggcatgccccgtgcttcgatgtctaagcaacctgctaactgaggcagcagtggagactgtgggagggcaaatgcagctcagagatgagcgtgttgtggcagccttatttatccttctgcagttctttttccagaaacagcccagtctgctccctgagggcctttggctcctcaacaacctcactggtacgcaccataatctgcccaggcctggacatttggataatggggatatttcctcatggcctaggctgaggtgggtagtattgacag

SEQ ID NO: 180 - DNA, 501 bp, Homo sapiens
  misc_feature (251)..(251): R = A/G
ctatggtgtgctttgctccatgacctaacgctacaattcatattccaaagaaaaatcccggtccaaagaaactccccatgccatgtttgtttcaaagagtccacaggtttgggagtcgtgtgttctctttgggcaagcatatgagctctttctctctaaattgcatttaatttgaaatggcctccatcttttgcagaaatgtgaattcctcctcttgaaggtctactgtgattcgaaaagctgctttttcrcctcagaaccgtattatgtaagtaacagccaaacaaaaatgcttatactggcatttgtcaaatctgtgatctgaatcccatggcacaaggtgccattctatttggcttgttgatgagtttttagttcaggctactatagaaatttatcatagattaggtggcttaaacagcagaaatgtttttctcacagtcccggaggctgcatgtccaagatcagggtgtcagtagggtccggttctggagagggctg

SEQ ID NO: 181 - DNA, 601 bp, Homo sapiens
  misc_feature (301)..(301): K = G/T
ctgggtgattggaaaaccctctgctaagattaatactgaacacttagcccaggaagatagatttttcctctagtttacatgtgtaagtagcttttttcctatcagaatgttcttttagggatggtgattcctgtttgtatgtttgtttgaatagtttttccttaacacttgagtgttcatttgacttaaatttataaaataatcattttctagtggacagttcttgtcttttctgttttaaaagtcacattgaatattttaacaggtttgtgtcccagacactttaaattcctctcaagakaaattatttggacctgtcaaatcttctcaagatgtatcactagacagtaattcaaacagtaaaatattaaatgtaaaaagagccaccatttcatgggaaaatagtctagaagatttgatggaagacgaggatttggttgaggagctagaaaacgctgaagaaactcaaaatgtggaaactaaacttcttgatgaagatctagataaaacattagaggaaaataaggctttcattagccacgaggagaaaagagtatgtattaagaactcatacttctatgcttgtcttcttattctgaag

SEQ ID NO: 182 - DNA, 601 bp, Homo sapiens
  misc_feature (301)..(301): Y = C/T
gtctctcatttcatcctcacaatccatgaggcaggtatgactattcttcccattatccagagagggaaaacaagtcacacggaagcaagtcacgcagcagagctaggattggaacagaagtgcctgcatcctccaacgcctgcatcccaacccgctgtgctatgcctcccgttgatgctttcccatgtctgccatttagctttgctctggtgagtgacaagctgtaccagcggaaagagcctgtcatcagttctgtgcacaccaaggtgaaggggatagcagaggtgaaagaggagatcgyggagaatggagtgaagaagttggtgcacagtgtctttgacaccgcagactacaccttccctttgcaggtgagcacctcgtagcattctcccaggctcgtcgctggtcaccgtcgccagggcctagctcccttcccctaggatctacagcctcactccagaaaaaacgctggtcctattttaaaagctctgtgaacatcccaactgagaaaacctaaaaattgcaaaactgggtgagatccaggagatgattctttgctttatcaagtcctacagggtttctcaaaatagcctcatgtcct

SEQ ID NO: 183 - DNA, 801 bp, Homo sapiens
  misc_feature (401)..(401): R = A/G
cttccccttcatcttcgagggccgctcctactctgcctgcaccaccgacggtcgctccgacggcttgccctggtgcagtaccacggccaactacgacaccgacgaccggtttggcttctgccccagcgagagtgagtgagggggctcgccgagggctgggggcgcccaccacccttgatggtcctgggttctaattccagctctgccactagtgctgtgtggcctgcaattcaccctcccgcactctgggcccaattttctcatctgagaaatgatgagagatgggatgaactgcagaccatccatgggtcaaagaacaggacacacttgggggttataatgtgctgtctccgccttctccccctttcccacatcctcctcgccccaggactctacacccrggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgaggtacctccaccctgtctaccaggttcagccccgccctctcatcatgtattggcccccaaaacgcggctcttccctcccatcagtttgtctttccactctcattggtcctcaggacgaccgtgactccgcccacctacaccacatttccaccactatccctgacttccaatggccccgccccagccactaaggttcggccttttctgcccagctggccgcctcttccttggtctggtgtc

SEQ ID NO: 184 - DNA, 801 bp, Homo sapiens
  misc_feature (401)..(401): R = A/G
agttctggttgggtgcagtggctcacatctataatctcagcactttgggatgccgaggtgggcagatatttgaggtcaggagtttgagaccagcctggccaacatgttgggaccttgtctctactgaaaatacaaacattagctgggcttggtggtgggtgcctgtaatcccagctattcgggaggctgaggcaggagaatcacttgaaccagggaggcgaagtttgcagtgagcccaagattgatccactgcactccagcctgggtgacagagtgagactgtctcaaaaaaaaaaaaaaaaaaaaaaacctgagttttaacttggtgactgttgactccctcctgacagcgaggcggtggtgaaccgagtgtttgacaagctgtccccgctgcacgagcrcatctactgtgcactctctggttcagctgctgatgcccaagccgtggccgacatggccgcctaccagctggagctccatgggtatgaagctctggagttctgactccccacccactagagctcccccaacctgcatgaatccctgtacagtgtgctgttccaggagctggacactgggaaatggaaaagtcttgtttcggctcttgctggcacttgaatctgtcagtttctgcatctgtaaagtggagataatatagtacctcatgagacggttattttgagaaccacattctatatgtgaacacagtttaaaagctgtaaatcactatcctgatataaataatcaggaagaaggtgatattgtgacccaccataatatcaggcagttaccatacgagaa

SEQ ID NO: 185 - DNA, 601 bp, Homo sapiens
  misc_feature (301)..(301): R = A/G
gataattacagtgatctggaagtcaccgattcccatactgttttcattgactgtcaagccacagagaaaatacttgaagaaaaccctaaatttggaataggaaaaggaaaaaacttgggtgtttcctttcctaaggataatagctgtgttcaagaaatcgctgaaaaacaagcactggctgtaggaaacaaaatagttcttcacaccgagcaaaagcaacaactctttgctgctactaatagaactactaatgaaatcatcaaatttcatagtgctgctatggatgaaaaggtcatagggraagttgtagaccaggcctgtacattggaaaaagcgcaagttgaaagctgtcagttaaataatagagatagaagaaatgtggactttacaagtagtcatgcaactgctgtttgtggatccagtgataattattcctgtttaccaaatgttatttcctgtactgataatttggagggtagtgccatgctcttatgtgataaagatgaggaaaaagccaattattgcccagtgcaaaatgatcttgcttatgcaaatgattttgccagtgaatattacttggaatctgagggacagcctctct

SEQ ID NO: 186 - DNA, 201 bp, Homo sapiens
  misc_feature (101)..(101): R = A/G
atctcggcaggagctttgcagtgaatatcgaaagcttgtgaggaacggaaaacttgcttgcaccagagagaacgatcctatccagggcccagatgggaaartgcatggcaacacctgctccatgtgtgaggtcttcttgtgagtagccctgcagctgggaacatggaggaatgattttgttctttctatttcatttccatg

SEQ ID NO: 187 - DNA, 601 bp, Homo sapiens
  misc_feature (301)..(301): Y = C/T
ttactccttagggtcaaaaccttgacagcagggcccgtatcttttccttcctcgataacctctgtaacacctcgcacaggactgaatacagaggaagcatttgattgtatgattcccactggtggaactaatagccttatattctttccctggagtgaaagaaaactctatattttactatacttacccatttcaattttacaagcaagaatgctgtgctggtgaaaataaactgcttcttcaataactttaaaggtttgaatatcccagaagccgtcagtacttaaaccagccaaaaacytctcattttttatagttggtcttcctgctctccaatgtgtatatgacagtggggtcttatcaaaccacataagagaattatctagagaagaaacatttttttcctatgcttagagattaaatcaagacttgaattacacttatacagttaagatttcaaacttgactaattttctcttttcccaaccttctaaaaggttgtatgattatgtataaccctttaagatattttctgattataacagtaaatcatgctcatttttaatttgaatataaatacaaactataaatattgacctat

SEQ ID NO: 188 - DNA, 601 bp, Homo sapiens
  misc_feature (301)..(301): R = A/G
ttgaagaaggtgcacagtgccctgctcctctttcctatgtccccagaattctcttagggttctcagatgccatgactttcaaggagagagtacggaaccacatcatgcacttggaggaacatttattttgccagtatttttccaaaaatgccctagaaatagcctctgaaattctccaaacacctgtcacagcatatgatctctacagccacacatcaatttggttgttgcgaacagactttgttttggactatcccaaacccgtgatgcccaatatgatcttcattggtggtatcaactrccatcagggaaagccattgcctatggtaagtcacctctcctttagcacattaggaataatctggctttggaaattaaaaaaagattccttactgaattgtgatttgacattttcatttgttgcatttcaaatttctttccagtttaacagattattttgtgccaatttatgtactcatcagttatcaaattttataaaactgcccttcttgaaggtgtgtgtatataatttaaaaattgtagatcgtattcagcttacatttttgagtaccatgtttagaaaagtaccaaaaaccacagt

SEQ ID NO: 189 - DNA, 801 bp, Homo sapiens
  misc_feature (401)..(401): H = A/C/T
tatttttcatgggtgtatccatattctaacatttcttcaccctccaaatttcagactttggcagtgaatctatggctctgcaattttagtgttccatgtaacaacgaataggaaaatgctgcttctaccctctcgaaagctattttgctaaagagctaagatgctaaaagctaaatatgtaactaaatagttgcaaatctcagtaactgacaaatacagtcatggggttggggatgctgtttagacagctgaaaataagacctgaattgtttatttttaaaatgttgcaaaagagaggcagcaaatgggaatttttaattctgattcttggtatgttttagaacaatgatttgttctttcttatactttcaggtgtttccaatgtggacactgaagagachaattcttatcctttttaacataatcctaatttccaaactccttggggctagatggtttcctaaaactctgccctgtgatgtcactctggatgttccaaagaaccatgtgatcgtggactgcacagacaagcatttgacagaaattcctggaggtattcccacgaacaccacgaacctcaccctcaccattaaccacataccagacatctccccagcgtcctttcacagactggaccatctggtagagatcgatttcagatgcaactgtgtacctattccactggggtcaaaaaacaacatgtgcatcaagaggctgcagattaaacccagaagctttagtggactcacttatttaaaatccctttacctggatggaaaccagctactagagataccgcag

SEQ ID NO: 190 - DNA, 801 bp, Homo sapiens
  misc_feature (401)..(401): R = A/G
actggacctgcggccccaagggctggagctgtttgagaacacctcggccccctaccagctccagacctttggtgaggattgaagaagccagcagggagaaggtgggggtggggtatcctgcaatgcggtgcctgtggccacaggatcttttgagatgggtgtggccccggctaaggggtgcatgtgttctaggcgtatgtgacctaggctgctgagtggccctggaagaggatctcgcaggagggggaatgaaatgccccagagaagggcttcgggacgtccatccctgtctgctcacacctttcttctctccctagtcctgccagcgactcccccacaacttgtcagcccccgggtcctagaggtggacacgcaggggaccgtggtctgttccctggacrggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagtaagaaggggcaggggcggagtggggcttcttgggggtgtgacctgaacccggggcggggctcactgtgtgcctattccaggctttccggcgcccaacgtgattctgacgaagccagaggtctcagaagggaccgaggtgacagtgaagtgtgaggcccaccctagagccaaggtgacgctgaatggggttccag

SEQ ID NO: 191 - DNA, 601 bp, Homo sapiens
  misc_feature (301)..(301): S = C/G
actcagttcagaacatctttggtttttacaaatacaaattaactggaacgctaaattctagcctgttaatctggtcactgaaaaaaaattttttttttttcaaaaaacatagctttagcttattttttttctctttgtaaaacttcgtgcatgacttcagctttactctttgtcaagacatgccaaagtgctgagtcactaataaaagaaaaaaagaaagtaaaggaagagtggttctgcttcttagcgctagcctcaatgacgacctaagctgcacttttccccctagttgtgtcttgcsatgctaaaggacgtcacattgcacaatcttaataaggtttccaatcagccccacccgctctggccccaccctcaccctccaacaaagatttatcaaatgtgggattttcccatgagtctcaatattagagtctcaacccccaataaatataggactggagatgtctgaggctcattctgccctcgagcccaccgggaacgaaagagaagctctatctcccctccaggagcccagctatgaactccttctccacaagtaagtgcaggaaatccttagccctggaactgccagcggcggtcg

SEQ ID NO: 192 - DNA, 801 bp, Homo sapiens
  misc_feature (401)..(401): M = A/C
aggaagatgtacgtcccatcttctgggcctccagaccaaagagttacatctaccgtacccaggagtgggacgagttccctaacggccgctggtgagggcctgcagaccttccttgcaaatacatctttgttcttgggagcgggagggcagaagaagtttgcatgcttgtggttgacctgggaggagtcaggggcagaatttacaggaatggcctcctgggcatgtggtggcactgccctctgtcaggagtgtgccctgacctctgggcacccctctgccaggggcaattcctcttcccctgcctttggggagctgaaggactactacctcttctacctgaagagcaagtcccccaaggaggagctgctgaagatgtggggggaggagctgaccagtgaagmaagtgtctttgaagtcttcgttctttacctctcgggagaaccaaaccggaatggtcacaaagtgagtgatgctggagtggggaccctggttcatcccctgcccctggcctgaccccagctgcaggccaggctgcggggctgtgacttccccatcctgtgccctcccctccatgctgtggacatggcaaagggagaagggtaagttgggagacctccacctggaagggcttagggaggcaaagacaggctgggtctttgttgggggccgtgagagggactcagggtgccaaacctgatggtcgccccagccagctcaccgtctctcccaggtgacttgcctgccctggaacgatgagcccctggcggctgagaccagcctgctgaaggaggagctgctgcg

SEQ ID NO: 193 - DNA, 801 bp, Homo sapiens
  misc_feature (401)..(401): S = C/G
actgctacaaatagaaatctttttcttcttctcttggagagccacttgttgaacacttaccagctcacctgtgcttgaaagtatttcttcaaataaaatgaaagctggttagctttgaaaattttttgtataaaagtttacacgggaaaaaaataaactaatttttttttccacctgtgttttcagggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagcccccsatactctattccgagtatgatcctaccagacccttcagtgaagcttcgatgatgggcttactgaccaacctggcagacagggagctggttcacatgatcaactgggcgaagagggtgccaggtaagaatgcgaagcgcagcttttaagagtcaatagcttttcaagaacttgttgtgatgtcatgggagaaatagtgggggaaaaagaagcaataacatgttatgtaattggtttcaaggttacaggagatgtgttcattttcagtatcaatacactgtaattttccaggagattaggaaataatatttttaaatcagaatctagaagactgaaattcttaaattgacataatttatttttaacccatctcatttaccaaaaagatttagggtggacact

SEQ ID NO: 194 - DNA, 801 bp, Homo sapiens
  misc_feature (401)..(401): Y = C/T
tcttttctatggccaccaagtgcaggcctgatttgcttggctgctcaaggcaggacagtgtgggagtttggagcaatccacccccactcttggaactgggctctgagccacctcccctgagagtcatctctggggtcagaagcatatcagtcatgagcccagccactcactgttttagttcaggctgtgctgtgctgttggaaggtgcaagatcagagcccccaaagcagaggactctctctgcccagtccctgtggtctcttcatccctcgccttgaacaggtggaggccagcctctcctgactgtcatccctattggcaggttaccccaaaggccaccccgaagcagggagctttgaggctgacctgaagcacttgaaggagaaggtgtctgcgggagycgatttcatcatcacgcagcttttctttgaggctgacacattcttccgctttgtgaaggcatgcaccgacatgggcatcacttgccccatcgtccccgggatctttcccatccaggtgaggggcccaggagagcccataagctccctccaccccactctcaccgcaccgtcctcgcacaggctgggggctctgggtggagtgctgagttcgctgagttcttcccagatctcctctcaggtccagaacttgcacagcgttgcttggccaccccattttggttacctctaattttccccccaaaacccagcaacagtgtctgttgaggggtttgttgtactttggccaacaagcatcaccaaaagggattctaattctcattacaaatcctgcttaaatcag

SEQ ID NO: 195 - DNA, 946 bp, Homo sapiens
  misc_feature (226)..(226): R = A/G
gttctgattgcctacaaggagtttggactttattgtggaggcagcggggagccaaggcaggttttagagtaggagagggtccaagcctgtgggtcacccttccgacttccctttccgaatgccaaacaccttcatgtcccccgtgggccccctttgtccctcccaccccaaactagccctcaatccctgaccctggcttccgcccccagccctctgacgtccatcrtctctgcggtggttggcattctgctggtcgtggtcttgggggtggtctttgggatcctcatcaagcgacggcagcagaagatccggaagtacacgatgcggagactgctgcaggaaacggaggtgaggcggggtgaagtcctcccagcccgcgtggggtctgcaccggcccccrgcactgacccaccaccccctcaccccagctggtggagccgctgacacctagcggagcgatgcccaaccaggcgcagatgcggatcctgaaagagacggagctgaggaaggtgaaggtgcttggatctggcgcttttggcacagtctacaaggtcagggccaggtcctggggtgggcggccccagaggatgggggcggtgcctggaggggtgtggtcggcagttctgatgggaggggcaagagctggaggcagtgtttgggggagggcagttacagcggagaagggagcggggccaagccctagggtggtgaaggatgtttggaggacaagtaatgatctcctggaaggcaggtaggatccagcccacgctcttctcactcatatcctcctctttctgcccagggcatctggatccctgatggggagaatgtgaaaattccagtggccatcaaagtgttgagggaaaacacatcccccaaagccaacaaagaaatcttagacgtaagcccctccaccctctcctgctaggaggacaggaaggacccc

SEQ ID NO: 196 - DNA, 511 bp, Homo sapiens
  misc_feature (256)..(256): R = A/G
tcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcrggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagcc

SEQ ID NO: 197 - DNA, 401 bp, Homo sapiens
  misc_feature (201)..(201): S = C/G
gtgaccagaccagacttttcagattgcttcctggaactgggcagggactcactgtgcttttctgagcttcttactcctgtgagtcccagagctaaagaaccttctaggcaagtacaccgaatgactcagtccagagggtcagatgctgctgtgagaggcacagagccctttccgcatgtggaagagtgggaggaagcagasggagggactgggcagggactgccggccccggagtctcccacagggaggccattccccttctactcaccgacatccctcccagcaccacacaccccgcccctgaaaggagatcatcagcccccacaatttgtcagagctgaagccagcccactacccacccccactacagcattgtgcttgggtctgggttctcagtaatg

SEQ ID NO: 198 - DNA, 601 bp, Homo sapiens
  misc_feature (301)..(301): M = A/C
gacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggmgggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagctt

SEQ ID NO: 199 - DNA, 511 bp, Homo sapiens
  misc_feature (256)..(256): Y = C/T
gagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaacyccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcaccc

SEQ ID NO: 200 - DNA, 511 bp, Homo sapiens
  misc_feature (256)..(256): K = G/T
agctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggkcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcaga

SEQ ID NO: 201 - DNA, 801 bp, Homo sapiens
  misc_feature (401)..(401): N = A/C/G/T
agtctggctgcccctcagccctggagtggggccgggaagctggagtcagctgtcttgctgggggaccccagctggttttgggctgaagggaagtgtgcatggggctgagaaggggtcacatgggggctgaggtggctgctactcaccagtggtgccatcggccgtgagggggccataccgcttcttgttcgcaattccaaacagagtgaatctgtacttgtggtcagggtccagtgaggagacaacaaatgaacgctcgggcccttccacaggtaccacctggggccgtccatccctgtccctgtactggaccatgaaggtgtcaaactggccctcagggacagtccaggagaggtgcagtgaatctggggtagggtctgtcacccacaggtttcccaggnggggtggagtccctggacttgggtcactctgaggcactaggaagagtgggtagagagaagggagagacttaggtccaaggagaatggggaagccaaatcccacataggaatgctgtgtgaggctgtgcaggttgttcactgcacaaaagtgcatttgctgagggagtacagagggactgaaatccagccagcactctgcttgccgagctgtgtgccctggtgaggagtggtgtccactttaaggaatgggtgccttctttcaaacggcatggaagcactgcgtggactagtgtggctctgcctccaaccacaaaccagagcagcagggagcttcagaaagaggggagcccagccaggccctttcacatctccatagccagggaaatcttcccagtacaac

SEQ ID NO: 202 - DNA, 601 bp, Homo sapiens
  misc_feature (301)..(301): Y = C/T
ctgcctccctgtttgcctctagggtggtgttgatgatgaggtctccttgactgcgtatgtcacagctgcattgctggagatgggaaaggatgtagatgtaagttctcctggctcctgctcttgataccctccttctcatgcgtattcctagagacattcacccatctttgtctctagtcacccttttaaggtcaagaaggataagatgatttcctgattacttgccatttttaaaggaatgccttataagttatagtcttcatcttcactttttaggacccaatggtgagtcagggtctayggtgtctcaagaattcggccacctccacgaccaacctctacacacaggccctgttggcttacattttctccctggctggggaaatggacatcagaaacattctccttaaacagttagatcaacaggctatcatctcaggtatgttggtcctgttgagagttctttgaaattgtgaacataagctgtgagttatctataatctccctagtaacctctgtcccacacatgtactctaggattcattttagtaacagttattaagtcatcaaattattgttgggaggtttgtgagaaacacac

SEQ ID NO: 203 - DNA, 601 bp, Homo sapiens
  misc_feature (301)..(301): N = A/C/G/T
ggctgggatcctctggcagccctgggtcccagcctcccgtgactctgcccatccccctcatcctcaccacccctggccacataccttttcttggcacctcgtcctgggcactgccttcattgtccctttgtggtctttgttctgagagaggctctgaggttctccctggccctggggcttaggcagaggtcatacagtcttattttcttgtccgctgggtcccagctgggcccgggaacctgctggggtagccacctgactgccacctcccttccctcagaatgtgtcgagccactgggcntggagaatgggaacattgccaactcacagatcgccgcctcatctgtgcgtgtgaccttcttgggtttgcagcattgggtcccggagctggcccgcctgaaccgcgcaggcatggtcaatgcctggacacccagcagcaatgacgataacccctggatccaggtatgcctggggatggccctggggcggggcaatggagagaaggctcgatgaatgtttctgcatttgggggttaccccaggagggttcatcactggggttcaggtggcaaggtaacaggttcccatggatgaagtatctg

SEQ ID NO: 204 - DNA, 801 bp, Homo sapiens
  misc_feature (401)..(401): K = G/T
aaaatttaaaacataaaataaaaaaagaagttaactcagaggaggaggtttctgatgagaaaggctagattaggaggcactgtaatggatcaaatgccctactgagttaattcatagtgacttttgaagagtataaaattccatttatttgctttacttctccatctcttgttatatctcctaaatataccagtaacatttctttgctctgtttccttccttcctttcttccttccttctttccttcttcctccctaatcaaaggttcccatcaaatacaataattcttagggaaaaatgttatgctttttattattttactaaaatactacaatttaaacatttttcatattttttttccagagggaaacagtcttttcctgcttccagacatgaatcakgtcactattcaatgggatgcagtaatagccctttacatactcttcagctggtgtcatggaggtatggtgttttatgtatctattgctatctttcattcaacaaatggaatattgagtgattatcattttcatggttttatgttagaatctctgaagaatacaaatattattagactagaaaaaatgtgtgcataaaaattacatagaatgaaataaaaatggcccaatctccttccaaatgcaggatttctttctcaaatttcccttctagacagccctcttactcacatgtggatatttccacaaaggagcttattagtttgagttggcatgttctattgtcaaactattataactgttatataattacctgtcaaacatttggatgcaattctatttc

SEQ ID NO: 205 - DNA, 801 bp, Homo sapiens
  misc_feature (401)..(401): Y = C/T
aattcaagaacccaatagggaaaattctttccactctagtattgaagctatttgggaagaatgtaaagagattgtgaaggcctcttccaaaaaaagtcatcagattgaggaactggaacaacaaattgaaaaattgcaggcagaagtaaaaggctataaggatgaaaacaatagactaaaggagaaggagcataaaaaccaagatgacctactaaaagaaaaagaaactcttatacagcagctgaaagaagaattgcaagaaaaaaatgttactcttgatgttcaaatacagcatgtagttgaaggaaagagagcgctttcagaacttacacaaggtgttacttgctataaggcaaaaataaaggaacttgaaacaattttagagactcagaaagttgaaygtagtcattcagccaagttagaacaagacattttggaaaaggaatctatcatcttaaagctagaaagaaatttgaaggaatttcaagaacatcttcaggattctgtcaaaaacaccaaagatttaaatgtaaaggaactcaagctgaaagaagaaatcacacagttaacaaataatttgcaagatatgaaacatttacttcaattaaaagaagaagaagaagaaaccaacaggcaagaaacagaaaagtaagctaaatgttattcaaaatattttaaaatacacaaagcattcattttgctatgcagctttaaaaaagttagatagtcatacttaatctggtaaagcgtagcatgtatgatgagtgaagaacttgaactttgtccatataaacctttgga

SEQ ID NO: 206 - DNA, 801 bp, Homo sapiens
  misc_feature (401)..(401): R = A/G
gaaaaattgcaggcagaagtaaaaggctataaggatgaaaacaatagactaaaggagaaggagcataaaaaccaagatgacctactaaaagaaaaagaaactcttatacagcagctgaaagaagaattgcaagaaaaaaatgttactcttgatgttcaaatacagcatgtagttgaaggaaagagagcgctttcagaacttacacaaggtgttacttgctataaggcaaaaataaaggaacttgaaacaattttagagactcagaaagttgaatgtagtcattcagccaagttagaacaagacattttggaaaaggaatctatcatcttaaagctagaaagaaatttgaaggaatttcaagaacatcttcaggattctgtcaaaaacaccaaagatttaartgtaaaggaactcaagctgaaagaagaaatcacacagttaacaaataatttgcaagatatgaaacatttacttcaattaaaagaagaagaagaagaaaccaacaggcaagaaacagaaaagtaagctaaatgttattcaaaatattttaaaatacacaaagcattcattttgctatgcagctttaaaaaagttagatagtcatacttaatctggtaaagcgtagcatgtatgatgagtgaagaacttgaactttgtccatataaacctttggaccataggttatgtgaaaagatcagcttataaaaatcatatgaaatattttctgaagaactcattcatagtttggatattccaaatttgtgaaaagatataattttgtaaagattgttaccatttcac

SEQ ID NO: 207 - DNA, 1543 bp, Homo sapiens
  misc_feature (85)..(85): Y = C/T
gacacttcagtgcatctctaatttgggaaatgatcaatggtcaacagaggggagactgtgtctagtagtttttacaattgtattyattaggcacaggaaaatgtaaactcagagagtctaagatagaaccaagcctccaggataaacttcagcaagcctaacccctttgtttctctttttctttctagacacttgtaacagcactaatctagaagtgagtacatatgagttctggtcctggcttagctaatttgggcaaaccgtttaacttctttgagacttaggtttccattctaacaaggtgtaggtgataatatccattttgtgcaaggtcattggtttttaccgtataacgtgtgtaggtgttacacacactgtaccatcccatacaaatgtgagttaatgtattttctgtctttattatctcttttacctgccttaatcaccaagacattgtgatctgtcactccatcttctccattaaactcttcaaccatttctattttttttggacaattacttatctcagtcatcatttcttataattccctgtctaaccctaaatgtctgtgagatccttgcccctcttctcaagtggttcaacacttaagaatggggacaattttatttttatttttatttttatttttatttttttgagatggagtctctcgctctgtcgctcaggctggagtgcagtgatgcaatcttggttcactgcaacctctgcctcccagattcaagagattctcctgcctcagcctcccgagtaactgggattacaggcactcgccaccgtgcctggataatttttgtatttttagtagagacaggtttccccatgttgtccaggctggtctcaaactcctgacctcaagtgatccacctgccttggtctcccaaagtgctgtaattacaggcatgagccaccacgcccagctgggacaattcttgttatatgttaatttcttaaaaccaccaaagtctattcaatatatgatatagtgattaagaaataaaggtgtacattgataaaaagtatgaagtttcacatatgcacattcttatagcactcataatggcatctgttaaatcttcatctaacttttaaaataaaatggcttgtaaaagctatgaattactaagctgtgggatgcttttgggatctcaagtagtaatgtggaagtctaggcactcagcactgtatggaatcaaaattcccagtggaatatggagagcagaaagattgggcagggagaacttgtgaaaatttaaacatgattttcaggttcatttggcaaaaaaaattaggtgacaatggatatttttaaaaaaacaccaccaacaagggcattgcctggccataatttattgagttattttaacactttcattctttgtgctttaggtattctgcttcctcatacttaaggtaattttgtaaaactttatggaagaaaaaacaatgacacacactcacacatagaatatttgtttattgctgttataataaattaataaaaaacccaagaaacctaaaacc

SEQ ID NO: 208 - DNA, 501 bp, Homo sapiens
  misc_feature (251)..(251): Y = C/T
atacatcagaaaactcatatgggagggaaaccttacacatgtagccaatgtgggaaagccttcatcaagaagtgtcggctcatttatcatcaacgaactcatacaggagagaaaccccatggatgcagtgtatgtgggaaggccttctctacaaagttcagtctcactacacatcagaaaactcatacaggagaaaaaccttatatatgtagtgaatgtggaaaaggcttcattgagaagaggcgtcttaytgcacatcatcgaactcatactggtgagaaaccctttatatgcaataaatgtgggaaaggcttcaccttgaagaacagtcttatcacacatcagcaaactcatacaggagagaaattatatacatgtagtgaatgtggaaaaggcttttcaatgaagcactgtctcatggtacatcaacgaactcatactggagagaaaccttataaatgcaatgagtgtggaaagggcttcgctttgaagagcccactc

SEQ ID NO: 209 - DNA, 601 bp, Homo sapiens
  misc_feature (301)..(301): R = A/G
gtgttccatgcagggacattgcaaatacatgaaagtcatcacaatggagatttttgctaccaggatgttgataaagatattcatgactatgaatttcaatggcaagaagatgaaagaaatggccatgaagcacccatgacaaaaatcaaaaagttgacaggtagtacagaacgatatgatcaaagtcatgctagaaacaagcctattaaagatcagcttggatcaagctttcattcgcatctgcctgaaatgcacatatttcagaccgaagagaaaattgataatcaagttgtgaagtctrtccacgatgcttccttggtttcaacagcccaaagaatttcttgtaggcccaaaacccatatatctaataaccatgggaataatttctggaattcttcattactcacacaaaaacaggaagtacacatgagagaaaaatctttccaatgtaatgagagtggcaaagcctttaattacagctcactcttaaggaaacatcagataatccatttagcagacaaatataaatgtgatgtatgtggcaagctctttaatcagaagcgaaacctagcatgccatcgtagatgtcacactggtgaga

SEQ ID NO: 210 - DNA, 601 bp, Homo sapiens
  misc_feature (301)..(301): Y = C/T
gttccctctgttggactccctgcccatattcttgtgggagtgggttctggagacatttctgtctgttcctgagagctgggaattgctctcagtcatctgcctgcgcggttctgagagatggagttgcctaggcagttattggggccaatctttctcactgtgtctctcctcctttacccttagggtgattctgggggtccacttgtctgtaatggtgtgcttcaaggtatcacatcatggggccctgagccatgtgccctgcctgaaaagcctgctgtgtacaccaaggtggtgcattacyggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaag

SEQ ID NO: 211 - DNA, 801 bp, Homo sapiens
  misc_feature (401)..(401): Y = C/T
aatcataatcatattaaatgtttaactgatagtattttaaaagaatcttcaatcaagtgctaatcctcatcactaaataaacagcattctgaatagtcaagattgggaaatgtgataggtaattctacccactttttgtattgtttctttgttgaattatttttgaaaaccactacaaaattccttattttgagacaaggcaaatctaagcctttgtgcaccatcattgttccccaagcctggaaaacaaaagagagagcaagaggaaaattaaatgtacatgcaattaaacattcctgttggctaaagtaaaatctggcccacagcaatttactcacctggccacatttgcagatgatttcaccatttatttgatagtcggcacacttcttttgcagtgytttgttttctcttacaatgtaaagttccctataagtatcaaagggaaagaatcatcatggagaactgacaaaataccagtgtgtagttcatgggttattggacctggagctcatccgcatgcctgcggtattctacacggcattccttccttccctcctgcttcccaggcttgttattgcaactaaggcaatgcttctcttctacacatacctctcaaggggcatgttgcctttcataacttctttcaagtctgttggttatattaacttgactttagttgttcaaaaatttgagaacaaatgatgagcatacaaaaatacgtgccttggatcaaaatggctttggttcttacacttctcttttcctgccccagtgcagtttatttaaaacatagacatt

SEQ ID NO: 212 - DNA, 2408 bp, Homo sapiens
  misc_feature (713)..(713): N = A/C/G/T
aggccctgccaggaaaaatataagggccctgcgtgagaacagagggggtcatccactgcatgagagtggggatgtcacagagtccagcccaccctcctggtagcactgagaagccagggctgtgcttgcggtctgcaccctgagggcccgtggattcctcttcctggagctccaggaaccaggcagtgaggccttggtctgagacagtatcctcaggtcacagagcagaggatgcacagggtgtgccagcagtgaatgtttgccctgaatgcacaccaagggccccacctgccacaggacacataggactccacagagtctggcctcacctccctactgtcagtcctgtagaatcgacctctgctggccggctgtaccctgagtaccctctcacttcctccttcaggttttcaggggacaggccaacccagaggacaggattccctggaggccacagaggagcaccaaggagaagatctgtaagtaggcctttgttagagtctccaaggttcagttctcagctgaggcctctcacacactccctctctccccaggcctgtgggtcttcattgcccagctcctgcccacactcctgcctgttgccctgacgagagtcatcatgtctcttgagcagaggagtctgcactgcaagcctgaggaagcccttgaggcccaacaagaggccctgggcctggtgtgtgtgcaggctgccncctcctcctcctctcctctggtcctgggcaccctggaggaggtgcccactgctgggtcaacagatcctccccagagtcctcagggagcctccgcctttcccactaccatcaacttcactcaacagaggcaacccagtgagggttccagcagccgtgaagaggaggggccaagcacctcttgtatcctggagtccttgttccgagcagtaatcactaagaaggtggctgatttggttggttttctgctcctcaaatatcgagccagggagccagtcacaaaggcagaaatgctggagagtgtcatcaaaaattacaagcactgttttcctgagatcttcggcaaagcctctgagtccttgcagctggtctttggcattgacgtgaaggaagcagaccccaccggccactcctatgtccttgtcacctgcctaggtctctcctatgatggcctgctgggtgataatcagatcatgcccaagacaggcttcctgataattgtcctggtcatgattgcaatggagggcggccatgctcctgaggaggaaatctgggaggagctgagtgtgatggaggtgtatgatgggagggagcacagtgcctatggggagcccaggaagctgctcacccaagatttggtgcaggaaaagtacctggagtaccggcaggtgccggacagtgatcccgcacgctatgagttcctgtggggtccaagggccctcgctgaaaccagctatgtgaaagtccttgagtatgtgatcaaggtcagtgcaagagttcgctttttcttcccatccctgcgtgaagcagctttgagagaggaggaagagggagtctgagcatgagttgcagccaaggccagtgggagggggactgggccagtgcaccttccagggccgcgtgcagcagcttcccctgcctcgtgtgacatgaggcccattcttcactctgaagagagcggtcagtgttctcagtagtaggtttctgttctgttgggtgacttggagatttatctttgttctcttttggaattgttcaaatgtttttttttaagggatggttgaatgaacttcagcatccaagtttatgaatgacagcagtcacacagttctgtgtatatagtttaagggtaagagtcttgtgttttattcagattgggaaatccattctattttgtgaattgggataataacagcagtggaataagtacttagaaatgtgaaaaatgagcagtaaaatagatgagataaagaactaaagaaattaagagatagtcaattcttgccttatacctcagtctattctgtaaaatttttaaagatatatgcatacctggatttccttggcttctttgagaatgtaagagaaattaaatctgaataaagaattcttcctgttcactggctcttttcttctccatgcactgagcatctgctttttggaaggccctgggttagtagtggagatgctaaggtaagccagactcatacccacccatagggtcgtagagtctaggagctgcagtcacgtaatcgaggtggcaagatgtcctctaaagatgtagggaaaagtgagagaggggtgagggtgtggggctccgggtgagagtggtggagtgtcaatgccctgagctggggcattttgggctttgggaaactgcagttccttctgggggagctgattgtaatgatcttgggt

SEQ ID NO: 213 - DNA, 1088 bp, Homo sapiens
  misc_feature (836)..(836): W = A/T
tgagaaaaccctgtctctactaaaaatacaaaaaaaaaaaaaaaaaaaattagctgagcatagtgatgcacacctgtaatcccagctacttgggaggctggggtgggagaatcgcttgaacctgggaggtggaggttgcagtgagccaagattgcaccaatgcactccagcctgggtgacagaaccagggggaataaaactcaacaaatgctgaaagccaaagatacgcagcaatccacctaatttgcaaaattgacttttagatcccacacagtcttgagcagggcaggaataatcagagtaaaagccagtggagaactcttcctgaaatatttcttcccatctccttgttgtctacctgctcatcccaaaacataaatgtctgtgcattcaaatcagactggcctgataaatgctaccaaggaaacatagatttgtcctcacttacatagtgtctagtatagagatgatgccccatagatttcactctacaacacaaatacatacacccacatttatgcttcagtttctctaaatgagaagggattccattatttttacaggacagtaactaaatccaaataaagagcaaaattcacagtggattcccatgaattatgtctccccagagaaaatttcatttcagatttctggataagctcattttcaaaagtcagtttttaaaggataccctctgttcatggacagcagatattgcttattggttcagttggcatacttactgacaaaagcaataaagaatgagattgccaatagcaggaaaaatatcaacagtgaggcacaaagcagcttggggaatccggtattacttttgwgaggggcagtcctctccttggaagctgaagaagaagccaaattagttttatcagtaataagtttggtctttacttcctcttcttcctcctcctctttctctctcttttcttggatgacacacagttactaacggtatgacatttgaaatcacatgagaataggaatagaaaggatataataatattcactgtagaaactttaaaaaatacataaaagtacgaattcctacaattgaggataactgttatgcc

SEQ ID NO: 214 - DNA, 654 bp, Homo sapiens
  misc_feature (329)..(329): S = C/G
caggatggtctcgatctcctgaccttatgatctgcccgcctcggcctcccaaagtgctgggattacaggcgtgagccaccgcgctgggctaactttgcgatttttgagaaaagactagaggttgtgcgttgtttactgtgaccttccaccctgaggaatttcccacacagcgccctgttcccctgcttaagggcagacctagttgatgtgtgaatgttgaagatccccttaatgtaatggcttttaaccttctctttcaggggcctctcaaatctcctccgagacgttgataaagaaccttagtaacttgactatcaacgctagtagcsaatctgtttcccctctatcggaagctttactccgtcgagagtctgtaggagcagcagtcctcagggaaatcgaagatgagtggctttacagcaggagaggagtaagaacattgctgtctgtgcagagagaaaagatggcaagattgagatacatgttactcggcggagttcgtacggtatgttgatgtgatgtggccggggctgtccaattccggagagtgacactcataaattaagacctaattaagactccctagctctaggcccggtgcggtggctgaggcctgtaatctgagcacttcgggaggctgaggcaggtggatca

SEQ ID NO: 215 - DNA, 1485 bp, Homo sapiens
  misc_feature (765)..(765): Y = Y = C/T
ccccagggtgccaccctccccgagattccagaagagcaaaggggccggggatgaccccatcgccttctaagcccaacgggaaaggctcagcggctggcaaaggaaggaaccaatagtgtgtgtggagggagggtggggactccacagggaaaatgctaaagaggggctgcctctgtggctgtggtcaggagccactgtcctacagagagggcactggcctgggagctgacacttcagaagaggaaaggactccccaggtgaggaaatcacttggaaggtgaccttgaaggcgggggaggggaaggctacccgaaatgggagaaagcagtgcaggctgtcagtgccccagcaacagtaactgtccagtctcctctctctgcggtggcacttgcttgttttctgagaattcctttgactgaaaagatagtcttttattcaacagttggaaatgcaagcataaactcctctgagcaaggcaaatccaggactttaactctcaccaagaagtatttgcctggactagcaggtgctctccagaaagctggtttggggatgacgggagaatagagggacacagaaacagctaggatcttggatggcaacttttaccctttgatgactccacagcttgagggcgggggcaggaagcaagtgtggagtagctttctggggaaggcggtgctcaccccagcctttgtctgcagagccccacccagcagaggggcagtggcgggcagtggacgtggtcctagactgtttcctggygaaggacggtgcgcaccgtggagctctcgccagcagtgaggacagggcaagggcctcccttgtgctgaagcaggtgccagtgctggacgatggctccctggaggacttcaccgatttccaagggggcacactggcccaagatgacccacctattatctttgaggcctcaggtaaaagccttccacctgtgtccttggtcctcccgggctccctccaccaggacagcccaggtcccgattacagccacacatactgcctcccgttggccctggtgttctcacgctaatttgccctctgtgtgtgccctgcttctccccagtggacctggtccagattccccaggccgaggccttgctccatgctgactgcagtgggaaggaggtgacctgtgagatctcccgctactttctccagatgacagagaccactgttaagacagcagcttggttcatggccaacgtgcaggtctctggagggggacctagcatctccttggtgatgaagactcccagggtcgccaagaatgaggtgctctggcacccaacgctgaacttgccactgagcccccaggggactgtgcgaactgcaggtaagaaaatgaaaagcaaggccaggtgtggtggctcacgcctgtaatcccagaattttgggataccgaggtcggtggatcacctgaggtcaggagtttgagatcagcctggtcaacacggtgaaaccccg

SEQ ID NO: 216 - DNA, 801 bp, Homo sapiens
  misc_feature (401)..(401): N = A/C/G/T
gtggtcactcaccagctcctcgggggtgagctggtagaagcccatccacatggcctgctgcagagcctcctgccccacatgccacacgtacacatggaccccagcagtcgtggtgaaggtcccatcgctgaccgtgacgttgaacgagtagtggccacgaggcaggccctgggcggcgataatcttgccatcaggcgcacccactgagaagtgcctgcccagggtctcctcttctgccaggctataggtcagcgtgtcctgggggtctcggtctgtggcatggatcttacccaccatgccaccctggaactcatcctctccaacagtgatgaagatctccagtgggagagcagaaggtgcatagtggctctgctctgtgacatggacacggacagacgtcnaagacgagaggggagggatgccactgtctgacgcctgtgggcaaaacaaacactgctgtcacccaacagaactgcagtgctcttgcgcccgactgaggctgggcctccttgtggagctacgtttctctgccccacgcccaacttgagggctggctcagcgcattgttgcatttagaaaaaaaaaacctaactccaaaagcactgacagaaaagaaagattttctgaaggttttgtagagattgaaggagggagttacatcctataccatgcagtaaaacaatgcagtttcctcatgtgacatctctctgagcctcttcctaaatctctccagccatagacttgggctaacttcctcatgaagtttctcattctgtccctgtcctcaagggcgccctcaga

SEQ ID NO: 217 - DNA, 1458 bp, Homo sapiens
  misc_feature (247)..(247): Y = C/T
cgagctcagggccctggacagaggaggcccaccaggctgagccctgggcaaggggaaggctgaggtcggctaggctgaagacgggcagcacaggctgaggtctaagctaaggaattttacccctccctaaccctccttcccgcctacccaagacatttttgacatcagaaagaaaaatgaatctgcaacttcaatagtcaggtcctgtctctgcaaataatgatgctttcgaagtttcagttgaacygtccctcgcgaaaaagtttctttaaatgtaagagcaggtcctttacaaactgggccacctcgattttggtgtctcggacatgcaagctggaaaactgctgcaggacaaagaggtcagcacatgagtagaacgccagaggccgggacgactcgcacaaaccaggggctttccagggactgtctcattcagtcctcacggaagtccccatgaggtgggtactgttagtacctctactgtacagatgtggaaattgaggcccaggtaggagttaggagcccttgagcccagatcctgtaaatcccgaaggccacgtccctgctgccacaatggccccacccctgggtggacacacaccatggatattcagccagcttcccttcagcgagcccagggttggcaggagggggtgcagggtgggtgtgagagggtgggggatgccttaccccagctgagaccttgtgcgggcagaatccgctcagcatcctctgggtcttctcgatggcactgcagcctgacacgttgatcagggattccagggctgcacagtactgtggggaggggacaccgaggggtcaggccctgcttgggcagctgccttttgtgagtctgcaggaagatggggctgagatgcctggcgcaggtgagtctgggtggtgggcgggaaggggccagattatggcgggagggaggagagcacttgaagcttgcttggaaccccagccatggaagggaggctcagagaagataagcccaaggcctggagcctctgccccatcctccctgcacccaaaggtccttaccatgccagctgtcaggttgatgctccataccatgctgccattgcagagcggagcctgtgggagcaaagtgacagtgagcagagtgctggcaggggttgtgggcctgccctggcagcccaggccaggtctgccccagcacaggccccacaagcatccctggtgtggcacagaggcaggcctggcagcccctcagcattcctgagcttcgttttctgctttgaacagcaggcataggggtgaggtcccactgtttagggtcttggagctgagagaaaaaaattgacaccactagtaagggacaagctgcatgcaaggcttgccatagtcagggcaggaggacaggggcctgcgggaagggccagggtggggacgagtgaagtaggagtggcctgggccactgttgaccaagac

SEQ ID NO: 218 - DNA, 3505 bp, Homo sapiens
  misc_feature (320)..(320): R = A/G
aagcaaagtcgaagcctgttgccttggtctgttgcttggttgtgaaatggagatgaacgtggcattgagaagacaggcaaagaaagcacagctgtggtcagaggctaagacattcaggaaatctgggggaagagacttcgggaattctttgtactcttctcccaactttcccgccagtctgaaattatgtcaaattacaaagttaaagaaaacagggcattgttctcgggtgcaagagagataataaatgtcttcttgcatacagtcccactgttcaagttcctgcccaagatgcccagactttatctgtgactgctccrtcagtcctgggagcaggtccaaaggcaccaagatagtaaaacctctgttcccccatctaggggttcccaagtcttgcctcagtataagctcaatcctcattatatcctaacacgcttacttgtttccaagcctttcggtctttaaaactaatagagtttattttttagaaccattgtagattatggaaaaattgagccgatagtactgagagttcccatacatccctctcccccatgcaaaatttcctcttttatcaacatcttgcattagtgtgtagtgccttccttataatgctgatacattattataaactaaagtccatagcatacattgtttcactgtttctcggggttttgttttgttttgttttgttttgtgtttgtttgcttgtttggaaacaaggtctcactctgttgcccaggctggagcagcctggaactcctggactcaggggatcctcctgcttctgccttctgagtagcttgggctacaagaacatgccaccacactaggcttttttttttttatacttttagagacagtcttgctacattgcccaagctggtctcagactcctaagctgaagttatccttccatctcagcctcctaaagtgctgggattacaagcatgagccactgtgcctaacctctgcagcacagttctgagtcttttttttttctttgagacagagtcttgttctgtcacccaggctggggtacagtggcgtgatctcaactcactgcaacctgtgcctcccaggttcaagcgattctcactcctcagccttccaagtagctgggactacaggtgcacgcctggctaatttttgtatttttagtagagacggagtttccccatactggccaagctggttttgaactcctgacctcaagtgatccaccagcctcggcctcccaaagtgttgggattacaggcatgagccaatgcacccagccaagttctgggtcttaacaatgtataatgccatggatccacacatgtagcaacaaaaagaatagtttcccagcctgggcaacatagcaagacccggtctctaccaaaaaacacaaacaaacaacaacaacaaaaaacaggccaggcatggtggtgcactgtagtcccagctactcagaggctgaggcaggaggatcccttgagcccaggagttcgaggctgcagtgaactatgatcatgccactgcactccagcctgggcaacagaatgagaccctgtctctaaaaaaaaaaagaaaaaaataaagaatagttttacttccctaaaaatccccaattctctacctattcttcctggattctggaaaccactgatttttttactgtctccatagttttgcctttttcagaatgtcacgtaattgaaatcagaaagtatgtagtctcttaatactgacttcttttacttagcaatatgcttttcaggttcctcaatgtcttttccaggcttcacacctcatttcttttgtggctgaatagtgccctattgtatggatgtaccacagtttatccattctacctattgaaagacatctttgttgcttccaatttttggcaattatgaataaagctgctatcaacactcatgtgcaagtttttgggtggacataagcttgcaacacaattgagtaaataccaaggagcacaattgctggatcatatggtaaaagtaagaaagtttggcaataaactgccagtgtcttcgaagctagctgtaacattttgcctttctatcaacaagtgagagtttccattgctctgtattcttgtcagcttttgatattgtcagtttgaggattttagccactctagtaagtgtatagtggtatctcatcattgtttgcaatttcctagtgacttaagatgcatatgtcaatgtttgcaaattaggaaatttgcaatttcctaatgacatatgatgttgaacatattttcatatgctttttgccatctgtatatcttatttgttgtctgttgatatgttgtgcccattttttagttgggttacttgttttcttattgtcgagttttaaaattctttgtgtattttggatacaggtcctttatcagacatgtgttttgcaaagattttcaaatttaatatagttttcaattttcataaactccaaaccaccaattttttttctcattcctggattatacttttagtgtcatatccaaaaactcattgccaaacctaaggacactgagatccaagattttatcctatgatatcttctagaaattttataattttgtattttacatttaggtccacgatttatgttgagttattttttgtgaaaggtgtaaggtctgtgtctaaatttattattattattttgcatgtagacatccagttgtttcaggaacatttgttgaaaagactatccttttcccactggattgcctttgcctctttgtcacagaccagttgactgtatttgtgtcagtatattttggggatctgtattctgttccattattctttttgtctcttctttcacctgcaccatactgtcttgattactgtagctttattttatagttttaaagtcaggtaatgtcagtccttcaacttggttgttgttcttcagtattgtgttggctattccaggctttttgcctttctgtttgaactttagaatcagtttgccaatactcacaaaataacttgctgggattctgatagggattgtgctgaatccgtaagatcaagttgggaaaaattctccatgaacatggactatctctccatttattgagatctttggtttcattcatcagaattttgtagttttcctcataaagatccagtatatgtttattagatttatacttaagtatttatttttctttcttttttggtgctaatataaatggcattgtgtttttaattttaaatgccacttgtttattactggtatgtgggaaagcagttgacctttgtatgttaactttttatcctgcaaccttgctacacacacttattagttccaagagggttttttatttaattctttaggattttctatgtagacaataatgtcatctgcaaacaaagaaagtttggtttcttccttccaaatctgtgtaacttttctttttttctgttgaagaaacccaaatggaagtttctgtgtgtaggggaatgcttctgggataagg

SEQ ID NO: 219 - DNA, 601 bp, Homo sapiens
  misc_feature (301)..(301): S = C/G
atggagacaaattcctctctccccacgaacacctctggagggacacctgctgtatctgctggctatctcttcctggatatcatcacttatctggtatttgcagtcacctttgtcctcggggtcctgggcaacgggcttgtgatctgggtggctggattccggatgacacacacagtcaccaccatcagttacctgaacctggccgtggctgacttctgtttcacctccactttgccattcttcatggtcaggaaggccatgggaggacattggcctttcggctggttcctgtgcaaattcstctttaccatagtggacatcaacttgttcggaagtgtcttcctgatcgccctcattgctctggaccgctgtgtttgcgtcctgcatccagtctggacccagaaccaccgcaccgtgagcctggccaagaaggtgatcattgggccctgggtgatggctctgctcctcacattgccagttatcattcgtgtgactacagtacctggtaaaacggggacagtagcctgcacttttaacttttcgccctggaccaacgaccctaaagagaggataaatgtggccgttgccatgttgacggtga

SEQ ID NO: 220 - DNA, 601 bp, Homo sapiens
  misc_feature (301)..(301): Y = C/T
  misc_feature (378)..(378): n is a, c, g, or t
tgataagattaatctaaagagcaaattatggtgtaatttcctatgctgaaactttgtagttaattttttaaaaaggtttcattttcctattggtctgatttcacaggaacattttacctgtttgtgaggcattttttctcctggaagagaggtgctgattggccccaagtgactgacaatctggtgtaacgaaaatttccaatgtaaactcattttccctcggtttcagcaattttaaatctatatatagagatatctttgtcagcattgcatcgttagcttctcctgataaactaattgyctcacattgtcactgcaaatcgacacctattaatgggtctcacctcccaactgcttccccctctgttcttcctgctngcatgtgccggcaactttgtccacggacacaagtgcgatatcaccttacaggagatcatcaaaactttgaacagcctcacagagcagaaggtgagtacctatctggcaccatctctccagatgttctggtgatgctctcagtatttctaggcatgaaaacgttaacagctgctagagaagttggaactggtggttggtggcagtccagggcacacagcgaggc

SEQ ID NO: 221 - DNA, 601 bp, Homo sapiens
  misc_feature (301)..(301): R = A/G
gtggtgctgggtgcataccaagcactccgtcagtgtttcctgttattcgatgattaggaggcagcttaaactagagggagttgagctgaatcaggatgtttgtcccaggtagctgggaatctgcctagcccagtgcccagtttatttaggtgctctctcagtgttccctgattgttttttcctttgtcatcttatctacaggatgtgactgggaagctctggtttcagtgtcatgtgtctattctttatttccaggcaaaggaaaccaacaataagaagaaagaatttgaggaaactgcgragaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcattttt

SEQ ID NO: 222 - DNA, 801 bp, Homo sapiens
  misc_feature (401)..(401): Y = C/T
tccaggtgcctgtatcacctgcccttctgctgacactcctgcctgctgttcctgactacagccatcatgcctcggggtcagaagagtacgctccatgcacgtgagaaacgccagcagacccggggtcagacccaggatcaccagggtgctcagatcactgcaactaacaagaaaaaagtatccttttcatcccctcttattttgggggctactatccagaaaaagtctgctggtaggtcacgtagtgctctcaagaagcctcagagagcactatccaccactacatctgtagatgtttcttacaaaaagtcatacaagggagccaacagcaaaattgagaaaaagcaaagcttctctcagggtctatcctccactgtgcagtctcgcacagaccctctaaycatgaagacaaatatgttggtgcagttcctgatggaaatgtacaagatgaaaaagcccattatgaaagcagatatgctaaaaattgtccaaaaaagccataagaattgcttccctgagatccttaaaaaagcttctttcaacatggaggtggtatttggtgttgatttaaagaaagttgattctaccaaggactcctatgtccttgtcagcaaaatggatctccccaacaatgggacagtgactcgtgggaggggatttcccaagacaggtctcctgctgaatctcctgggcgtgatcttcatgaagggcaactgtgccactgaggagaagatctgggaattcctgaataagatgagaatatatgatgggaagaaacacttcatatttggggagcccaga

SEQ ID NO: 223 - DNA, 801 bp, Homo sapiens
  misc_feature (401)..(401): S = C/G
gccctccccaataactgcatttctctatttttttctccttctttctctccctcatgcccctcccaacccctcatctccctgtcttcctcagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctasagttcaaccctttcaggagggcacctatctggccaccatacacctgccatacctgcaaggacaggtcaccctggagcttgctgtgtacagtgagttgggggacagaggtctccaggggtagagggtgggcactggattgtggggaccgtaatagggggagggatgatggataagagggtgcctgggcaagtaagtagagatagaaagaggttcctgggagttagaggggtaatgggaggctagaagtttcctggaaatttgaggggctttgacatgggtatttctgtgacgcaccaatggagagacagtgggttccctatttcaggagaagaaacctaaccttctttagttctgaggaagccagcaggcaaactgagggtctcttagggaggacagtatg

SEQ ID NO: 224 - DNA, 601 bp, Homo sapiens
  misc_feature (301)..(301): N = A/C/G/T
tctttactttgttatagtcagatgaatccttgtctatttttaaggacacctccacggatcctgtcagagtgctcagctggctccgcagagacctggagaagagtacagcagagttccaagatgttcggttcaaacccggagaatcatttggtggggaaacgtccaactcaggagacccacacaaaggtttctctgtagactattacaacaccaccaccaagggcactccagaaagattgcattttgagatgactcacaaagagattccttgccagggccccagggcccaacttggcaacgngagttcagtagatgaagtttccttctatgctaaccgcctcacgaatctagtcatagccatggcccgcaaagagatcaatgagaagatcgatggctctgaaaacaaatgtgtctatcagtcattgtacatggggaatgaacccacacccaccaaaagcctcagtaagatagcatcagagcttgtgaatgagaccgtctctgcatgttccaggaatgctgccccagacaaggctcctggctctggagacagagtctcgggatcatcacaaagtcccccaaatttgaaatacaagtccacttt

SEQ ID NO: 225 - DNA, 801 bp, Homo sapiens
  misc_feature (401)..(401): R = A/G
gaaaatcatcatgatggagacagcaatgacgccatggtcccaatcacagaacatatgcagtcccaccagccccccttttctagctttacagcccacagccagaaggagctgccatttatcatgcacttaagattagccaggcactgttttggggttcacccagccctcacacaaccccaggaggcaaaggaggctgagccccggagaagttaatcggcaggaagccgcagctgccagggcgcaggcaggatttgaagtcaagtgtgttgaactctggagtctgagtttgcaactaccggcattgccacttacccctagggagctgcccacctttgtggggtggaggcctggtgctgtcttctgtcccccacccctctgacccatctttctttctgcagccragaggccccagcaacatgcagctacaattccagagacccctggccctcagttcagccaacaacggggtaagtttttgcatgtcccttcagttcccgggacacaggatcccactccccaggaaccccaggccctccttgagggtacaagatctcaccagtgttcaggggccctgtcccacccaccaggcagctcccatacagtgttcagagccaagacccagccctcacagtgggagaatctgaatggctgagcagtgatttctccagtcagacaatagctgaccctcaccatgcacccgccacatgccaggcccagcgcagagcactctgtgcacatcccccaccctcagggcacctctgcggtgcgtcatgatgaccccgttatcatgacacccatttt

SEQ ID NO: 226 - DNA, 601 bp, Homo sapiens
  misc_feature (301)..(301): R = A/G
gggtcccttgcagaagactatggcttgagagtttttcctagactagaggggcagggacccttaggagtccctagggaagataggggttggacagttacctgggaagatgggcaagatcctgggggtacctggggataaagatgggattcaagtactctagggagatggaccaagattgggagtgagggctgaaccagaagaggctactctggcaggtggagtcagtctgagcctcctcatgtaccagcctctttctcctccctgccctccgcctgcagagggaccagcaagaagtgatccrgaagttccaagatggaaccctgaaccttctggtggccacgagtgtggcggaggaggggctggacatcccacattgcaatgtggtggtgcgttatgggctcttgaccaatgaaatctccatggtccaggtactcacatcctcctccactcagccgcccttataggatcctgtgtggggccccagcccaactcaggacaccccttgtctctcttcccaggccaggggccgtgcccgggccgatcagagtgtatacgcgtttgtagcaactgaaggtagccgggagctgaagcgggagctgat

SEQ ID NO: 227 - DNA, 672 bp, Homo sapiens
  misc_feature (472)..(472): R = A/G
cactgttgcccccgactactcatactgtttttctccatagctgtttttttttttttccccgagacggagtctcactctgtcacccaggctggagtgcatggcacaatctccacctcctgggctcaagcaattctcttgcctcagcctcccgagtagctgggattacaggcatgcgccaccatgcccggctaattttgtattttcagtagagatggggtttcaccatgttgcccaggctggtctcgaactcctgacctcgtgatccacccgccttggcctcccaaaatgctgggattacaggcatgagttactgcatcatcacagcaatagagcttcttttaagctccagggagggttaaggaaagtctcttccaggtacaaatgatcttagttctttgggaaccttttgtcccccaaggaacgttctcttaggccccagccatgcctggtgtctcctcccaccccagatccrggatctgcagcaggcagccttgaccaagcgggcggcccaggcagcccagcgggagaaccagcggcagcagttcccagtggagcacgtgcagctactctgcatcaactgcatggtggctgtgggccatggcagcgacctgcggaaggtggagggcacccaccatgtcaatgtgaaccccaacttctcgtgagacctgtgga

SEQ ID NO: 228 - DNA, 997 bp, Homo sapiens
  misc_feature (498)..(498): M = A/C
tcccctaaagcattgaggataaagcgaagagcattccagatcttgttgcagaaatgtcggcagctctggacctcagagactgacaggtgcaagtcgcccgctggaagggaagaatcgaggtagtctgcatgtaggtggcagcagcaccagaagtcctgcccctgccctgcccctgcacaggtgcccgctgccctctgctcaccccgacacccctcgcccaggcttaccctgaactccatgggagcagagtgtgaatctcagggcatctgtcccacactcagggatcccgtgaggaaagtcctttttctgcaaccagaggaagaagaagggtggcagatgcctttgtggctgcagggccaggacctgggttgcagaggaagccagaggtggtgagctagagctggtggggggcaggcagcgatgactcacctgtgctgcagccacaatggccagctctgcagggtccaaatttccgcttctcagcttttcctgcagcamctggggatggaagggggcaattcacgacccaggtcgaaggccctgcctctataagggtcacacctgctggcctcactcctccctcagcctgccttcctctctcctgcaaaccctgcaaaccttgtccctctagtgggtgcttcgtcctcacctgcatctccaccccactgatgatgtctcttgggtccagcacattccccagggacttgctcatcttccggccctgcctgtcccgaaccatgggatgaagaagcacctgggggcagggaggggtcaacagaggggggtttccttggaggtgccttgggatctctggcctccatacttttgggggtagggtaggaagtgaattaggaaaaaggaatcagcaacgtggaaaggaccacattaggggttagaagggaggacaaggtttggggaacactggagtcacagaaagcggcagggcactgaagggctcttaccttgctgaagggcagctgccctgtgagctgggtcc

SEQ ID NO: 229 - DNA, 639 bp, Homo sapiens
  misc_feature (201)..(201): M = A/C
ctttgagagtcctaaatgtggctccattggtcctttggaaaagctgcagggaggactcagggcagtggggtgctgagtgtgttggagacagttgcagatccttgacagttctcttccctgacagcgctgtttccagtcacactgcagtgtgccaacatcagcatcctggagaacaaactctgtcactgggcataccctggmcacatctcggacagcatgctctgtgcgggcctgtgggaggggggccgaggttcctgccaggtgagaccttactctggggaaaatgaggctgtcctgccaagttttctaggatttaggggagcagaggggtcggcccccagccttcctgggtcaaaatgagaaggagactgggatacctggttcctgggagaggacgggaccagggcctggactccttagtgtaaaagagaaaaggtctggaggtccagacttctggatctacaggaggagtgggctgggcgtccagagtctgagtcctcggggaggaggaggttaggtcctgcggggaggtgggccctctgagcttttactcctgggtctgaggaagaagaggctggagatggaggactctcggatgttggaggaggaaggggctggggcctttctgggagggaggaa

SEQ ID NO: 230 - DNA, 601 bp, Homo sapiens
  misc_feature (301)..(301): R = A/G
gacatgctgctgctgctgctgcccctgctctgggggagggagagggcggaaggacagacaagtaaactgctgacgatgcagagttccgtgacggtgcaggaaggcctgtgtgtccatgtgccctgctccttctcctacccctcgcatggctggatttaccctggcccagtagttcatggctactggttccgggaaggggccaatacagaccaggatgctccagtggccacaaacaacccagctcgggcagtgtgggaggagactcgggaccgattccacctccttggggacccacataccragaattgcaccctgagcatcagagatgccagaagaagtgatgcggggagatacttctttcgtatggagaaaggaagtataaaatggaattataaacatcaccggctctctgtgaatgtgacaggtaaggcacaggctccaggaaaggccacagggaaaggtcatgggggcggcagggaaaggctgggatggagcccctgccccaggagagggcttagggtgaagcgagttggctcagggcaggagctggaccagagcctgagctccccccagggctgcaccatggatcctctgacctgat

SEQ ID NO: 231 - DNA, 681 bp, Homo sapiens
  misc_feature (425)..(425): N = A/C/G/T
ttgataggaattgcttgtattttttttccagtttataatttatatttttttcctatatcgaaataaaaagtgtgtgtgcgtgtgtgtgtgtgtaaaagaaagagagagaaagagaaatttacttatcctttcctttgtggaccstgagttttatgtcaaatttgaaaggatttttccagttccgaaattatttttaaaattatgttgtgtttcctattattttatggttttatttttcacatttgtaatgtatttttaacttatgtttttaatgcagcaagattaccttatgctggctactttggatgagaatgaggaagtgatagatggaggcaaaaaaggagcaatcgatgaccttcagcaaggtgaattggaagcatttattcaaaatcttaatttggcgaagtatacaaaagcttccttanttgaagaagatgaaccagctgaaaaagaaaattccagcaaaaaagaagtaaaaatacctaaaataaataataaaaatacagcagaaagtcaaaggacatcagttaataaggtgaaaaataagaataggccagaaccacattctgatgagaatggcagtaccacaccgaaagtaaagaaagataaacagaacatctttgaattttttgagagacagactttgttacttaggcctggaggcaaatggtatgatctgga

SEQ ID NO: 232 - DNA, 601 bp, Homo sapiens
  misc_feature (301)..(301): R = A/G
actcatggaagagatgaacatgataaaagagatgcaagaaacaagcttattaaaaatcagcttggattaagccttcagtcacatctgcctgaactgcagctttttcaatatgaagggaaaatttatgaatgtaatcaggttgagaagtctttcaacaataattcctcagtttcaccacctcaacaaatgccttataatgtcaaaacccacatttctaagaaatatctcaaagattttatctcttctttattactcacacaggggcaaaaagcaaataattggggaagcccttacaaatctratggatgtggcatggtctttcctcaaaattcacaccttgcaagtcatcagagaagtcatactaaagagaaaccttacaaatgttatgagtgtggcaaagcctttagaacacgttcaaacctaactacccatcaggtgatccatactggcgaaaaacgttacaaatgtaatgagtgtggtaaggtctttagtcgaaattcacaactctcacaacatcagaaaattcacactggagagaaaccttataaatgtaacgaatgtggcaaggtcttcactcagaattcacaccttgtaagacatc

SEQ ID NO: 233 - DNA, 601 bp, Homo sapiens
  misc_feature (301)..(301): M = A/C
tcaaggagcagttggctgtgagagagggagggctggtcagggtgactcactatggcagctcccacatcaccccgtgctgcagctgagaggaggggagtctgcacactgatgttgtccctgccttggactctcctacagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagamctgggaactcacagcatccgcctcccaccagccgccaggttagcactcgctttgccccaggagaggtcagttccccattgctgcttctgagatcggggctgagatccggcacaaggcagctttataccatcaatccaaagtcaggattcactgggcagcctgctggccccggccaccagccacggcgtcctggcctgacctctttctccgtggctttctctgtggctggggcagctgcaaaagcaagcccacacccccccaagatgtgacagggccagccttatcacccgcatggcagag

SEQ ID NO: 234 - DNA, 601 bp, Homo sapiens
  misc_feature (301)..(301): S = C/G
aaacagcttgtaaaatataattttctacaaagaatacaaagtgattatttttattggcgattattgtgctttatttggaagacttattcttccttctttgtttttctcctaggaccactgaggttcctttcacagacagaatctgtcacagccttcatgggagacacagtgctactcaagtgtgaagtcattggggagcccatgccaacaatccactggcagaagaaccaacaagacctgactccaatcccaggtgactcccgagtggtggtcttgccctctggagcattgcagatcagcsgactccaaccgggggacattggaatttaccgatgctcagctcgaaatccagccagctcaagaacaggaaatgaagcagaagtcagaattttatcaggtattgcaatgctctttgttgccttcagaatgatattctctggaataagttgaaaaacaatttttttctttaacagatatttgtaattgttataagttctgtattgttcattgcgttttgtttattatttctttcttccttgccgaagcattcaatcaggttgtaccaaaagctgttcttttttttttttttcatgtcttgttg

SEQ ID NO: 235 - DNA, 801 bp, Homo sapiens
  misc_feature (401)..(401): Y = C/T
tctgcctgggcctcggtccctcctgcacctgctgcctggatccccggcctgcctgggcctgggccttggtgggtttggttttggtttccttctctgtctctgactctccatctgtcagtctcattgtctctgtcacacattctctgtttctgccatggttcctctctgttcccttcctgtctctctctgtctccctctgctcaccttggggtttctctgactgcatcttgtccccttctctgtcgatctctctctcgggggtcggggggtgctgtctcccagggcgggaggtctgtcttccgccgcgtgccccgccccgctcactgtctctctctctctctctctttctctgcaggttctccccatgacaccacctgaacgtctcttcctcccaagggtgygtggcaccaccctacacctcctccttctggggctgctgctggttctgctgcctggggcccaggtgaggcagcaggagaatgggggctgctggggtggctcagccaaaccttgagccctagagcccccctcaactctgttctcccctaggggctccctggtgttggcctcacaccttcagctgcccagactgcccgtcagcaccccaagatgcatcttgcccacagcaacctcaaacctgctgctcacctcattggtaaacatccacctgacctcccagacatgtccccaccagctctcctcctacccctgcctcaggaacccaagcatccacccctctcccccaacttcccccacgctaaaaaaaacagagggagcccactcctatgcctccccctgcca

SEQ ID NO: 236 - DNA, 801 bp, Homo sapiens
  misc_feature (401)..(401): R = A/G
tctaaggacttatttatcccttagacaatagatggataacttggtcgatagcatctagatttaaaaaggccacgcaaagggcaatggtacctctcaggggctgtgcagacggtgggagagtgctcagaggcgtcagaaaggcccaggcccatagcagcccagtcttgagcctagtagacctgccagccccaagtcggacaggatggagcccaactcatgtggggaggatggttccggctgagtggctgtgccaggtcagaccccacctggagacggtgtcttttctgtcaggacatcagttatgtgacatcttccccatcctcatgttttttagcatctgccacctccactgcccagcaaaactccgcctcctccccctccaaagacaactcgcaagcagrcatcggtggactccgggatcgtgcagtgacgtcgcaagcctctctggaaagagtgtgctgcccctccccatctccatgccctctccttctgtgtcccctgagtctgctgtttacctcattgggcctgtgatgttaacatttcgtgcgactgctttttcttcaaaggagttcagttctcaccatggagtgagtggcctttagcgtcatggagcaaggtgggtctgggaggtagatatgggtccgggatgtgctatcgtagttatcagagttgggggcctctgagtgtgtctggctctgagagagtctgagtcttgcccaaacattctttctttttgtgccaaatgacttgcatttgcaaagagctcaattgctctgagctcagccaagtaggagaggctag

SEQ ID NO: 237 - DNA, 601 bp, Homo sapiens
  misc_feature (301)..(301): S = C/G
tacttatcagtgccaagcgtccagctcacgaggcaaatacaccctggtcgtggtgatggacattgagggtgagctaatacggggctgcgggtctggaccggtaagccggggggcgggggggttggagacagaagggacgcatattgacttagcgctttctctgcacagctgggagctcccactttgtccccgtcttcgtggcggtgttactgaccctgggcgtggtgactatcgtactggccttaatgtacgtcttcagggagcaccaacggagcggcagttaccatgttagggaggagascacctatctgcccctcacgtctatgcagccgacagaagcaatgggggaagaaccgtccagagctgagtgacgctgggatccgggatcaaagttggcgggggcttggctgtgccctcagattccgcaccaataaagccttcaaactccctaatctgtggtttgattccacccgcgctgcaagtctctcccacccaggtgcacatccactgagtagcgtcgctgcgacggaagggggcggggcctgtggcgcgcagacgcagcttgaactcttgagaggtgggctggggcttagccaacggg

SEQ ID NO: 238 - DNA, 601 bp, Homo sapiens
  misc_feature (301)..(301): K = G/T
gtgtcattcattaaaaagaagaataaaaagaactctttttttcttaaagctgtcatcatcttgtgaaatatcagtttgcccttgactaggaaattacatcaaattaaaccattcagtcccctagaatagcagtagggctggtttattctgaaaacctttgctgggtcttacatgcagataacttgactttccttctcttctcctttctgtcctcaggtgacggcaattgcctcatgcatgccacttctcagtacatgtggggcgttcaggacacagacttggtactgaggaaggcgctgtkcagcacgctcaaggaaacagacacacgcaactttaaattccgctggcaactggagtctctcaaatctcaggaatttgttgaaacggggctttgctatgatactcgggtaggtttttccccctaattatctactaacagagctccatggtgggcatagggtacccctgggcgagtccctgccctctggtagcatctgatggactaggtcacatgaatttggctaagcgaagcatactcaatggaaaacaccagaaacctccagtgggactcacccaaggcttttgccctgcttttggttag

SEQ ID NO: 239 - DNA, 601 bp, Homo sapiens
  misc_feature (301)..(301): R = A/G
ctggagaaactggtgtggataggaaggagctgagtatcagcttcatgtgggggtttggggaggtggcaaggggtgaggggagaggagaaagcagaaaacagcaaaattgtgtcattggcctgcatagcacagatgtggtgcctgagaatgagggtcaatgaataaacaagaaaccagcttttccactcagctaagaggtatttattcagttgctggcacctctcccagtgtaaatctggacttggctccagagaaggtgtttcattacagcgggggcttagtttgcttcctgtagttagtrgcgtttcatggttttctttatccagtgtacaaagcttgagactttggtgcaggctcgtggaggcatgccattgtttcgtccataggagacaatgccctgggccaccttgttacacacaagagggcctccagagtccccctgtgaatagagagtggaaggactgagctgatgctcctccgggtcctgccctctcttccatctcaagcccccttttagaaaaggccaacttgcacagcctacatgtgggagaccagagggcagggcaggccgctggtggcccccagctgccaagctctggcc

SEQ ID NO: 240 - DNA, 801 bp, Homo sapiens
  misc_feature (401)..(401): Y = C/T
cttcccaagtcccagaggcatgagaaagagaatggagggcagagagccgaaggggcccgaagcatcatggccatgtccacccttaggaggctcggatgggtgcccatccaaagactcgagtgcctcctgagtcctcttccagtgctcctcctagactcaaggatacaactgcaggggcccagtagagcccaggccacaggtgtgtctaattctgagccagaggacttcacagttcagtccccacccctcaaattagttttcttctctgggcgcatgggctctgttcccagtctggtccaactcccccatccagctctcctgccggcaggcacaagtgaggtctcccactcactaaccacgctctttctcctccctggcagcctctgcctccacacagaccycctggactccccgcgacctggtctcttcacagacccagacccagagctgtgtgcctcccactgcaggagccagacaagcccctgagtctccatctaccatccctgtcccttcacagtgagtttcggggtgcccgtagccacacaggcctgggcgggggctggcagatggagacttgcctccccagcccgtcctctccccttcctgtccctctgccttccaggccacagaactccacgctccgccctggccctgcagcccccattgccctggtgcctgtgttctgtggactcctcgtagccaagagcctggtgctgtcagccctgctcgtctggtggtgagtgtggtgtgggttgaactcggggaaaatggaacagggaacagcttctgcccaggatagag

SEQ ID NO: 241 - DNA, 660 bp, Homo sapiens
  misc_feature (486)..(486): R = A/G
cccttattactgctgctcaaaagagtaggaacctaaggcaaagagtggtaagataagttactcgagtttagtctataartagcgacagatgtactaaacaaggaaaattccacctttctccttcatggggctaggacgacaatcagcccacattctcccactctgcaactgctgggtgatagtgggccttgctgggacctcatgccactatgctcccattctaaggtgacgttccctcctcatgtgggctttccttgaggcaggtgtgtgagtcggtggctcactcataacttgctgagtagctaaagagctgatttagtgtaggaatgttgtgtaaatttcaagccttgtcctttcgtaaatagtcattgcaaagacaaagaaggtgtatttaacaaacttgaattgtttccaggtcacccatttgctgtagcagtgtttgaggattatgtgtggttctcagattgggctatgccatcagtaatragagtaaacaagaggactggcaaagatagagtacgtctccaaggcagcatgctgaagccctcatcactggttgtggttcatccattggcaaaaccaggtacatactggagatgttacacagtctttccttggctggaatctgcaactgttttaattgtttgatgtcatgcagtt

SEQ ID NO: 242 - DNA, 801 bp, Homo sapiens
  misc_feature (401)..(401): Y = C/T
tcagtccctccctttccccataaaccccactcacaagtcagtctggggcattgcctataaggctcctgtccttcctttaggactcagtgcagtgttctgcattggtgcccccacaacatgtccatcaaacaccttttcattctcagaccattaccttctacagagaatgtctgctcgtattattcattctttcttctttgtcccctaaacttacaccctccttgcttatcacctcattccccaaccagtttcaagaacagatgaagggttaatactggtaaccgtcagtattctctgcccttcctgtagtcccggaaatagaaattgtgagtccggttcctcatccaggaaaggggcagagcatggaagagccagggctgggcgcctactccaagatcacygtggggaagggatctggcccatgccaagattctgctgctccatcaggtagaccgggtaggaattggggccaccctcatcctctgcatcattgtactgggtgttctgggttagtgtgcggcgtgtccgcatcatataggagacctgtgattgggatgagaaaggaggaatgagaaccatctgcgatttgttttccacaacactcacctcaggtcttgattctattctcaagattccatccaaaccttgatgtttattccagctccaggtccaatacaatgagtcccagctccatctccagttccccactctaccatattctccttgtctttacacctcctattctcataccccagactctccaccccccacactttctctttcacaccctttcattctcag

SEQ ID NO: 243 - DNA, 401 bp, Homo sapiens
  misc_feature (201)..(201): Y = C/T
aggcaggtgagtctgtccccagctgtcctaggtccctcctcctctctggggacaagggaccacccctgggcagctgggggtgaagacagcagttctgggctgactgatggggatgaggggggtcctggggctgagagctgggatctgagggttgaggacatcttgggacctaacctgtaatttccttccagaaaacctacycaaacccatcctgtgggccgagccaggtcccgtgatcacctggcataaccccgtgaccatctggtgtcagggcaccctggaggcccaggggtaccgtctggataaagagggaaactcaatgtcgaggcacatattaaaaacactggagtctgaaaacaaggtcaaactctccatcccatccatgatgtgggaacatgcag

SEQ ID NO: 244 - DNA, 601 bp, Homo sapiens
  misc_feature (301)..(301): N = A/C/G/T
tactgctgcaaaagaaaacaagcacgaaggaaaccaagatgatttcttcgggctgatacaacctgttctgacctgcaaaaatcctaccttcccccacctccccaccgtaatagtcatagtataagggttgtacagacgcctcaggagacctgcctgattcctttacatccttctccctaacatctagactatctctagagctgtttcctagtcgtgaatgcgtgatggtccttctttgtccctgcaagtatgatccaacatggcccagttcagaatcagaatatgtcttctgtgtcatggnggcatttggtccatggtgggagaaagaaatcaacttttcccagtggtggagtgaggacaggggagggccggccctctcagccttggatgtgatccatttgctgtagtcttccaccttggtgtacagaaacaggccagggcacgtctcaccaccgaagttcaggactcctctcagaacccacagatcgaactgctgtagctggcacatcattgggcttcctgggtccccctgtgataaaagacagaaggcttcaagtcttagaaaaactagtttttgttgtaaatctatccttgtgcaata

SEQ ID NO: 245 - DNA, 601 bp, Homo sapiens
  misc_feature (301)..(301): Y = C/T
ccctcatgctagcaatcctttctcagtcagctctgccattacagaggatggttgtaacaaattttgtcctctgaaactaagcaaaatatatcaatttctcacagctgacagagccaaaaggtggaaaggcttgatataagtaaaacaatggaatgcttagctgcaggcctagaaaggaccctttaattgccaggctctgtcaccatatcaagcgtggtagggttcggggctgaagcatacttacgaagacacacaaggcagtagctggtaccctcacttctttaccagaaccaggatgagyatccacattgtcctgggggactgggaaggaagagacagagcgtctcctaagaaataacataaagacaaatattagacaggattgcagaggtttactgctcatcaaattgttagaaaggactccaagacgaccttgcttaagcagactgcctctgttgatagcctgtccttctagattcttcaaactacagaacaattcacaaaaaaatcaaaagcaccctcactcaaatgagaaagagagccagcacatgccttactctcctgcacactaacctgtggactccaaaacccaacaatgaaa

SEQ ID NO: 246 - DNA, 801 bp, Homo sapiens
  misc_feature (401)..(401): R = A/G
ggggcagagcctctggagatgtctgagtcacaaagggacccagaaccctggagtgatgaagtccaggcagtgccacggtctccctggcactccactcgggtggagggtggatggaagggtgacagggtgttctaagagttgaggccagcggagaggagggtccaaaccaaggcacgacagggaggggaggcaggggatagactgggctccacagggcagaagcccatttgtgaaatcaaaagcagcccactgagggatgcaaggcccatcacccttccctcccctaagggcactgtggactgggagggggccagagaccctccaggcagagctcctggcccccaacccagcagcccggctctcccttccagctctggggcgctgctttccatggaccaacrttactccaccggcgctcccagggatcaccaatgacaccaccatacagcaggggatcaggtaggcacctccctcccccacatcctggccacaccccttccacccacagccccatctgactctgtctccccaacagcggtcttattgacagcctcaatgcccgagacatcagtgttaagatctttgaagattttgcccagtcctggtattggattcttgtgtgagtcaccagattcccctcctcttgtgtccttgccttcttcctccctgatcctctaccccctcgcccaatgtctgaaacacaggctttggacagaggaggaggagccagagctccgaatggattccaagaccaacaggatttataagggaaagaggcctaatctggggacattgggtggt

SEQ ID NO: 247 - DNA, 601 bp, Homo sapiens
  misc_feature (301)..(301): N = A/C/G/T
atcataagagcacataaaaaaatttcaaacttcatacatccactgaaaatagaggctaggtttttattaaaattctactttctttgtgttagaagatacacctcttgtctcccaggccagtgctctttctggagtgcccaaagaccccttctttcttttatgttctgaatcagtgccatcagctttctctagtcactgctaactactgaacaattcatgggctgtgatcagaagcacttacctgcatagcaggtcaggaataagacaagcagtcccaggacaactgtcaggcgaagtactnagacagccattctggtagcacggggtattcgtgcagataaattgttcagatacatgtgaaacaatgctccatttatagggcatagataggtgacatcatctgctttggaatttagattgttgcacaagatgtctgcacagcttgcttttggatctgtactaatgagacataccctatcattcaaaccaaacattttacatatagggaaagaaaaaccctcttgatttttaaaatttgtatctataaagggttctggagtgaatctcttgaggctagtttcaaggccagcattgataatta

SEQ ID NO: 248 - DNA, 801 bp, Homo sapiens
  misc_feature (401)..(401): S = C/G
cacagctggccccacaggtcccccctcagctggccccacaggtccccccactgctggcccttctacggccactactgtgcctttgagtccggtggacgatgcctgcaacgtgaacatcttcgacgccatcgcggagattgggaaccagctgtatttgttcaaggatgggtgaggaggcggggttgtgtggatgcgggagggggctttgcggaggggctgcccgtcccttcccgcccactggccctgtgtccaaggcttagagcccgtcctttccctcctcgctttctcaggaagtactggcgattctctgagggcagggggagccggccgcagggccccttccttatcgccgacaagtggcccgcgctgccccgcaagctggactcggtctttgaggagcsgctctccaagaagcttttcttcttctctggttagttacctactttccctcccccgcccggtcaatccccatcagtcaaggaggctcaagagaccatcgataacccacgaaacgtcttgtgcgttttagaaaaatacgccccctggcggacgcagtttagcaaacgtaggggcggctgagtttctgccccctcctctccacgccctcgcgtcgctctacccagcgcctctgcccctgggttgcagggactgcgggcacgcgggctaggaaaggcctcgccggaatctccctcctcgcgttctaggagtacgtgctccctctgcgcccccaaaccgacgtgaccctcctcccctgcagggcgccaggtgtgggtgtacacaggcgcgtcggtgctgggcccg

SEQ ID NO: 249 - DNA, 701 bp, Homo sapiens
  misc_feature (501)..(501): S = C/G
cacagcagcctccacaatgccaagcaaattcccagtcctcttctggcttcatccctctgtagcatagatgtggtcatcactcagtttttcctttactggatctctgggacactgctctttcctggttctcctcctgctcattgatcgcttcatcttcccaacttttcagtgttagactgctgctgggctcagtcattgaacctcttctctttctgtatcactccactggtgatcttacagctttctatcctatctgtatgctcttaactcccagaagtggcaggcacatattaagtgctcagaattatttgttgaatgaaggttttggcattgtattaataaagttccatagtaattgttttgatttttttgcagctcagattggtcctccagaagtacatttagaagctgaagataaggcaatagtgatacacatctctcctggaacaaaagatagtgttatgtgggctttggatggtttaagctttacatatagcttasttatctggaaaaactcttcaggtgtagaagtaagcattatttttacctctgtttaatcgatgtgagagaaaaattaggcgaattaatcctaaaatttgactttatacttttttaaagaaccaacttatatttgtgttataggaaaggattgaaaatatttattccagacataaaatttataaactctcaccagagactac

SEQ ID NO: 250 - DNA, 601 bp, Homo sapiens
  misc_feature (301)..(301): S = C/G
aaagagtccttacattttggacacttatgacccataaggacataattgaggaccttcatcttaagttgctgggactgtgactggctatagttttcttttatctagtctgtggtttgtaaagtgtgacaatgatcaatttcatgatttgaaaaaaccttttaaacataaaaagacaagcaaatgattgtacaagcccagactgtcctgtagagaggcagaatatgcttgaaccaggctggttcagggagggctcccttcccaggggcctcctacctttcagggaggaacttctcaggctctstccagtactttgggtcatgatgaagaacatagcttggaatcatcaccaccacccctttgggaataaacatcccattgatttcaacatcttttttgcagaccctctcaagtctcatagcaactgggaataatctgagtgtttcattcaccaccatgtcaagatactccaactgtagcacagtatcataggtgggtggtgcctgaaaagaaagaaacagatttggataaattgagatttttgaattaacttttaactcagtccatgtagtactgttgaactgttagaagttccagagaacaa

SEQ ID NO: 251 - DNA, 601 bp, Homo sapiens
  misc_feature (301)..(301): M = A/C
tcagtctatgtctgtgtgtcagttgctgtcatcagtctctttctgtatccttcctttttctccagatctatgtatctctctgaccctctgtctctttttctacagtatccacagtcttgggaaatggctcatctctgtcactcccagagggccagtctctgcgcctggtctgtgcagttgatgcagttgacagcaatccccctgccaggctgagcctgagctggagaggcctgaccctgtgcccctcacagccctcaaacccgggggtgctggagctgccttgggtgcacctgagggatgmagctgaattcacctgcagagctcagaaccctctcggctctcagcaggtctacctgaacgtctccctgcagagtgagtgcaccagtatgctggggaggggctggagaggagaacacacctcctccacccttagtaactgctgagcgtggaccttcagagaggagctccgctctggtctgtgctcagctgtgaggtctggaacttccctgggacccacagcaccactgtcctcttcctgccagggaagggttgtggggtggggagagggcaggagtggatctcagaggggacaggatggggc

SEQ ID NO: 252 - DNA, 801 bp, Homo sapiens
  misc_feature (401)..(401): R = A/G
atttaatggtattatccagtgtgaaagtattttttaagtattttattaatgcacaaatcctcatatctgtactgtatcctttttaaaggattttatcggatacagggacagcttacaacacagaaaaataaaggcactaattctaaaattctgtaattctgcttatgtatgggagatttcggaccactactgacaaaatgcacattaaaaataagaatctatggcctctcctcttggaaaggtttgcattagcaactggagtaacatcagcatacaggcagcagggagggcacagcttggaatgggcacaggctatcttttttcctgacttccatttttctttgaacataacagcattaccttctgccatatcaacacagtccctttcctatacatcggcrgctcattattatagttgatgttgaattcagaaaacaaaatctcattcttgtctgctgcaagagttccctgagaaaataaaaatagatattaaaagctctgcatgtcttctttctcccctagtgctactatccattcgacccacaacctaaatttccacaatcaagaagtggaaggattttatcaaacatcttatagttattagtaaattttcatcttaagggcaattatgatcttacttagataaaattctctcctataccaaacactggcttcacaagtcaagactgaaagggagtggggagaattaatactaactgaatacatattatgtatttggtccagtaaaacttagaaaggttatataaattccccaaggttaaaaggttgtccttattcttc

SEQ ID NO: 253 - DNA, 801 bp, Homo sapiens
  misc_feature (401)..(401): R = A/G
agaaagcagactcaactgtgacacagcagagaccatctgcctttccagagcttactgcagctgaaaagacagataatagtgtgtgggcagagggtgaacctggagacttgaaggaaacaggcccctcttcttggtggacagtagaggaaaataaaggaaaaaatcagggtgaggaaactgaccaaactgggctcaaaatccatgcatgctcactgacacttttctggcagcagtggccaggagcagacttcatccttgtgaggtgggtatggcaaccaaccctgcgagtagtgggatggggaaggggttgcctctgcacctatgtgcaattatgtggcagtctctgaccaccttcctggtttcctgctctgattgcaggggggacatatggtggaaaaccrtgatggagctcaggagcctggatacccaaaaagccacctgccaccttcaacaggtcacggaccttccctggacctcagtttcctcacctgtagagagagaaatattatatcacactgttgcaaggactaagataagcgatgatgatgatgaacacactttgtgaataataaaattatctgaatgttttattcctgttgtttcctaagtttccttcaaactctgtctgcatccgcacatttgatctctaggggaccagcttctctagtttgccctctttcctccatcataaccctttcttatcttcagttcacctgatgtcccctgtacgtctgggagctgccttagatgctgttataatcagggaagggcactgtacacaagcccagtgagtagaaaggc

SEQ ID NO: 254 - DNA, 401 bp, Homo sapiens
  misc_feature (201)..(201): K = G/T
aaaatattactccatggaacttagatgtttttgctaattcttgaataaagacaaacaagtttgtattttaaagtaccaaactacctaatgtgccaagaacttttggcatattatgtgactttttctagaataaaaaccaaggttatttgtataagacattggaaacaaattcctcttgacattttctttctgtttatcagkggcctgaggcttccaccactaaacgcaaagctgtagatacctattgcttggattataagccttccaagggaagaaggtaatgatgttttttagcatatgtggaaattgatattattgtattctgtagctctggaaaaaactaattattcagatttctgtgaagggtttagcctgaaaagaatctgttgagaaaggagaaa

SEQ ID NO: 255 - DNA, 601 bp, Homo sapiens
  misc_feature (301)..(301): R = A/G
gtctggacaagctgggcctgggagccgacgtggcccaggtgaccggggccctccggagtggcagggggaagatgctgctgttcagcgggcggcgcctctggaggtgagcgccgccgcggccgccggcagggggagcccgggcgccgtcggtccgtccgctagccggctcagcacctgtctcctccgcgcctgcccgcaggttcgacgtgaaggcgcagatggtggatccccggagcgccagcgaggtggaccggatgttccccggggtgcctttggacacgcacgacgtcttccagtaccraggtgagggctgaggaggatcccttcgtgagacaccacactaagctcctcttagtgagtggtcaaattctgagcgaggaagaaaaagcccttggaaatggaaacaaatgccccagcacagacaagatcccagcagaggcagaggccttctccaggtcatttaggaagtcagggatgcaaccaagaccaggacccagatttcctgcctccccggctggaagctctttctccttcagtacaggacggcaggtggtttgtatggaagctcagttattagacaacagtcatcaagtgccgataa

SEQ ID NO: 256 - DNA, 801 bp, Homo sapiens
  misc_feature (401)..(401): R = A/G
tgctggcaaatgcccaagttgggcttcgaaagggacgagacctcagccttttgaagtcatccagccccactcagagtccagcatagttcctaccacccagatctatgcttcctagtgctcactgattgggtgtctggacaactatcagatttgcccatctgtggatctttcctagtcctgtctacttacagaaagaacttgacagattcaaatggaatctaagagagcccattcctgctggaaacaggggaaaggaagtatgactccccaagtctcttcacctgcatgtgtctacctgtatataagatggctgagctcttctttcctgcctatctttttcccagaactgtttccagcgccaattctcagagctgtaccctcagctgaaccccaagcaggargccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgagttcgcatcagagtgcaggttgtctgtttggcatgcgtgtgagtgaaaaggagggataggataaattgacctgtgagctggggttcagtgtgagcaggttaagaagggacacagagggggcaggaacaatgggccagaatccctgatgatgagagacagcacaaatag

SEQ ID NO: 257 - DNA, 601 bp, Homo sapiens
  misc_feature (301)..(301): Y = C/T
cactcgcatatacccttaagtggattcagttcttgacgttagctttatgcatattaattctcacttgagaaaaggtggcttacattcattatttctgttcttcacttgccctcctccccagctcatcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggycttcacactcaaggccacggtcctaaactaccttcccaaatgcatccgggtaaggaaaatgagggtgaacaggaaaggtgggtagaacaaaagattcctttgatcagtcagctactgattctgttcctgagactaaggataattcaagggattgtgtgttagcactgtgaataattagtgctatgcaaagcaggacatgatcagaaagataatacaatgatatatgtgctatgggtgcttaaatcacggctctctaagccacaccttgcttttctatttcttagcgcttgcagaattctt

SEQ ID NO: 258 - DNA, 401 bp, Homo sapiens
  misc_feature (201)..(201): D = A/G/T
cctcacatggccaggatgggtgaggatcaagtcataaccacccttccagggagctgctaagacttagggccatggcttggggctcctggtgctcactggccttgtgggggacccactgactttcaagtgtagatgtggatgtgggaccagggttgctatggggcagtgggctcagctctgggctctgggatccacaggagdtgaacaactaccggcgggccatgcagaagatggcagaggacatcctgtctctgcggagacaggccagcatcctggaaggagagaaccgcatactgaggagccgcctggcccagcaggaggaggaagaggggcagggcaaagccagtgaggcccagaacacgggtgaggatgtgcaggccaccaagggcacccgggcttct

SEQ ID NO: 259 - DNA, 501 bp, Homo sapiens
  misc_feature (251)..(251): N = A/C/G/T
aatcagatctctgaggagataaagagtttttgttttgttttgtttttttttaactctaaattcctacaaagaaaaactggtctcacactgggagacagatgagtagaggaactgtttacatatcctcaaacccccttcacagctgtgctgccttctctgactgtctagaatgtgacttccatagccttctgtcttgtgggttctctcacctgaacaggctccactgtggattccatcttcaattgtccacngttgttctccttgttccaacttgaagagtgcatccggtttgctggcttgataccctgttcatggaaaatgatagaggacttagacatatcaaattgggctggcaatgtcaagaaggaagaatgttacatttcaagaaacttgagtttcttaaaatacccaaaatttagtttcttatctgaaactatgaaagtttcgtttcatatctgtaacatcaaggtttttctcttacaagagggtagattacaccgt

SEQ ID NO: 260 - DNA, 601 bp, Homo sapiens
  misc_feature (301)..(301): R = A/G
gcttccctcacctgatgactccatcagtggagccagtacacagcagactctcggtgactggaaccatgcagtcgatagattcagctctcagggcaaagcggtcacttgtggccccaaagccattccaattgaagaggtagatggtaccttcactggagccacaggctaccttcttcccccactgcagggaaatagagaaaacaatgtggaagctgcctcagactaagcccccagcacacacccctccatcccaccataaccagctgtactttcatgagagtgacagaggtcaggtccccaractgaggttctgagagcagctcaaaccgacgcctcttaatgttgaagatgccaaggcagccatccccgctgtagagagtagagcagtaggcttagacgcaaggtctatttgaggaagacatttcacacagggaggggaggggaggcaaggcagctttgaagttgtacctggctgtcagcagcagctttttggctggatccagagccatgtctgcgatgtactcttcatgttgcctcatatccattaaggggccctccttccgctggtcccagagacggataccacctgtgtcatccccag

SEQ ID NO: 261 - DNA, 713 bp, Homo sapiens
  misc_feature (217)..(217): N = A/C/G/T
agtccgagggtctccttgggcccttcagctttgtaaggaagatgagagagagtcggccgttgatggtgcagactgaggtgaggcagtccctcagcaacacaggacgggaggcagtgggacgagggaccctggggctccacgcagctcagacctggggggacgcctctcactcccgtgcctgcttcccaggctcagtacgtattcctgcatcagtgcntcctgcggttcctccaacagtcagcccaggccccagccgagaaggaagtcccgtatgaggatgtcgaaaacctcatctacgagaacgtggccgccatccaggcccacaagttggaggtctaagtgacgagggggctgggtcggcagcccaggcatcctcaagctctggacacccacttgagcccagattcctggaagagcagagggctgggctcccagactcctgggtgctgtgggaggagggggctggtatcccaaactctggtttccccaggagagagtggtctggtgggcttcagatgagtcctatgggagctggggatctggattcctggttccctgaaggaggagagggatgatagcttggattccctaggtctttccaggatgcagaaagaaacaggctggggcctggattctgaggcaggaaggaatttgggtctggagttctggctacttgaggaccaaaggcaggaaggatcctgccttgattttac

SEQ ID NO: 262 - DNA, 601 bp, Homo sapiens
  misc_feature (301)..(301): N = A/C/G/T
tcacgtggaactcgtggctgccacactggacagtgcagaactgggcctccctgcctccacctgctggatgcaatggttaaggaagggctggaaagtttgagggccagaaactacaactgattttccctcctgtgctggttttcagctcccaacccagtgagaaacctgacagtggaggctcagaccaacagctccatcgccctgacctgggaggtccccgatggcccagacccacagaactccacctacggggttgagtacactggagatggtggcagagcagggactcgaagcacagcanacaccaacatcaccgtggatagacttgaacccgggtgtttgtatgtgttttccgtgtgggtggggaagaatggaatcaacagctcccgggagactcgaaatgccaccacaggtgagaggcagtcgccatttgtttgatctcttatttgtttaagggacagtaagcagtagaatgtagacgattgtctattccatagtccctctgggccatattgagccaggtactcatgtccacatcctggggcagtctcagctcaggagatgaagaaggaatgaatgtccatggtacctccagctgcta

SEQ ID NO: 263 - DNA, 401 bp, Homo sapiens
  misc_feature (201)..(201): N = A/C/G/T
ggggtcattgccggagcctttgtgggcatcctcctgtttctcatcctcgtgggcctgctgattttcttcctgaagaggaggtgagactcagcacagggctgaccgcctggagggtgggggctggagaagaaggaggaggaccgctggttgcagcctcaccccctgagcctctcatcctaacgtccttttcccaggaataanaagaagcagcagaaaccagaactcagggatctggtctttaggtgagcagaaggtctggggggtgcattggaaagaatctggtcaaatcaaggggtgtttgctggctgccagctaggtcagagggtggatcaatgcatttacccacaaaggtctcagaaggggcccatgcctctgcgacagggaccacggcccttccatcg

SEQ ID NO: 264 - DNA, 801 bp, Homo sapiens
  misc_feature (401)..(401): Y = C/T
tacatgtatgtatgacaataagataatgaaccacagagaaaaaaaaatcagttaatgatttcataatcataccttatatatgtgtgacattttcagttctttgactacattaaagtaatttgaattggttacttgctgtgggtaggaagttaagccagctccatttcattatttccagttcttcacgaaagaaatgaaaaggtttgggggtaaggtgtattgctaattctttcacatctctgttgtaaaatttggttccattcttgattgcttttgttgctattatttcctttcttcttgtatttaaacattgataattacttttcagcaggataattgcactcacttggaatttgtataactgtagtacactcaccttttccagctaggtaatgaagagyttcttttcattgctagaacatcattgcacagctcctgtttttcttcaaaagaacatagacaaacaatcgcatttggatgatcacacaataaactgaaccaaaagaaatgttagcagttcattaactacctctgtataatatggatttgtattgaaacatccatttataaaactgtaccagttgtaacgagatctataatatgttcttaaggtagtttataatgttttaaaataaagtttatgtagtatatatagttatccaagagagtgtagcttttttttggtaatttttaaatggacattttttaccagagcctggagtatgatcagaactgttgattccctgctttcaccagcctctaccaagacaaccatcttcccccaataacccactctctcct

SEQ ID NO: 265 - DNA, 601 bp, Homo sapiens
  misc_feature (301)..(301): W = A/T
agcaagaacttgtctcaaaaaaacacaaaaaacaaagagtagggtggaaagggagtcctgctgaatcagagcagctccctcgctcagtggaggggctgcagcagacagtatctgctgtggagtaaaagggggagcccattcagagtgagatgggaagcattttgagtgtcctgcctcctaatctttctttactccctctttcccctatagaccatagtaacctgggaggaggagcacctggtgtgtgtgcagaaaggggaggtccccaaccggggctggagacactggctggagggagagwtgctgtatctggtaaatggggtgggggctgggtgtctgggagaagggcctccagctataaggcatccccttgtccaaaccagataggtccaccactcttcccccagcccagccccaatccctatccaaggaattgaccagggagggaaagcaaaagcactgggaggagtggggagaggaagaaacagagtggccaaggtgggccctggctacgagtcggatgaatgcccataaatcatcactggcgagatggaggcttcagccactcacatcccctgacccagccaccttccttcctgag

SEQ ID NO: 266 - DNA, 601 bp, Homo sapiens
  misc_feature (301)..(301): R = A/G
gctggacccccttctggtcctctccatcccccagccttgtcaccaactcccatgaccaccccatgcttggcctgcagacctgtgagagggacttggtttctgtggtttgaccctcgacacattctgagtacagaccttagacccaggtctctgtgcctgcacggttctgagaagaccccctgtgcacacccagttccatcccctgaacccagactttgggtccacagggcagggctaggagtaggacaacggaaaaagctttacctgaatttgttgttgagctctttcagcatgaagagcratttcttcagtttctagaaagagagggaatgacagagttctcaagccaggatgaataaaaacactgttttttcctttcttctggaaacctggccacagcttgcaggagaaggctcacagcccaccacggaagttggtttacatatggggctacctggccaaggacctggttgtcagctgacaagtttagcttgtctctcactccaactaaactgtagcaacttgtgtaggccctgcctcttaatgggggacctggaacagctgggcccccacccatccagccctggcagaggggcctgcc

SEQ ID NO: 267 - DNA, 549 bp, Homo sapiens
  misc_feature (349)..(349): S = C/G
accccggcccagccaggccagccagcctcggcctgggcccgcaagcctacggccccccggccccgcccccggcgcccccgcagtaccccgacttctccagctactctcacgtggagccggcccccgcgcccccgacggcctggggggcgcccttccctgcgcccaaggacgactgggccgccgcctacggcccgggccccgcggcccctgccgccagcccagcttcgctggcattcgggccccctccagactttagcccggtgccggcgccccctgggcccggcccgggcctcctggcgcagcccctcgggggcccgggcacaccgtcctcgcccggagcgcagaggcsgacgccctacgagtggatgcggcgcagcgtggcggccggaggcggcggtggcagcggtaaggacccttccctcgccctgcgcctctggacctgcaggtgctcgggcgcggcccaggccgccccctgtctgacctctgctccggccctgctcgggttcccgggagtgtggccctcctgtccactctcgccctggggggctg

SEQ ID NO: 268 - DNA, 801 bp, Homo sapiens
  misc_feature (401)..(401): R = A/G
tttttttgcccagtcaaatcctatttacacttccacagtctcacctaaattgttcttgctccctgacaccttccctggtttcctttgagttctcagattttattgtaccctgtatgttcgtacctattttattctgtttagattatagtggaatttgcttatatattgcttgtattatatggggacattgtgctatgttttattttttcctatctcttggcatatgatgtttttcttgttgtcaaattgaattttacatttgagaaaaacacaattaaaatcctcagctcaaagagatgtaacattagtttctgccaatgtagatgtttgaaccttctgctttaagtagaaatgaaatatatggccaacttacttcttctatctcggcaggagctttgcartgaatatcgaaagcttgtgaggaacggaaaacttgcttgcaccagagagaacgatcctatccagggcccagatgggaaagtgcatggcaacacctgctccatgtgtgaggtcttcttgtgagtagccctgcagctgggaacatggaggaatgattttgttctttctatttcatttccatgttcaattatgggagggccacttcaacataaaaatgaaagaattaaggcatatttagagaaactgtctgattggagacatgtatttgaaaatccatgtcctttgaagattgtcaagacttcacacttaagcaaggagaaagtcataatcttgaaatattcaagtagttttgtcttttaagtgtggaaacaggacaagttctagcttatctccgtgaataaa

SEQ ID NO: 269 - DNA, 601 bp, Homo sapiens
  misc_feature (301)..(301): M = A/C
gcgctgtgcaaatccccgttcacgggtgccctccaccaccattccacagctggcaatgcagttgcacggggccaagcagcctgctggggatgtggactgggaagcagcctgctggggatgtgggctgggaagcaggccagccccgtctgaacaccagctgtctagggctaggacctggaccctttcccacgcagcatcctgtcaggcgagaataaggcatttctgccaaactctgccttctgagtagccacccagccctccttcccccacctgttgttgttgtaatattccaggtagaatmtcttgggccgagacagttcctccacgcggcgggacaccgctatgcaaaatgggaaacggagtcagtgaaccccagtgtcaacaccctgcagttcccaggggcttctgcatgcggaattcagcttttcatgagcttgggcaggaggctgaattggaagaactgtgggcagagacaactgggggccagacaccctgcagagagaagacttgctgtccctgatttagggacaatgggctcagaggcttgaaggtcctttctcggacaccggatgggagtggcagggctggaacagcagcccag

SEQ ID NO: 270 - DNA, 801 bp, Homo sapiens
  misc_feature (401)..(401): Y = C/T
taaatgagatttaaatcaaatattacagaagtaagtgagggaaacatagctgttgtgaataataataaagaaaaatgagggagatgatggggaagggggtcaaggggatagcaaagggagatggatggggagatgacagaggacacttaccttgcctagccctgttgagctgcctctcctagggctgggctcagaccctcagtcctgcgcctttgagggcccaactgcctcattgctgctgtcacctcttgcttcttcagggatcctgtatgtcaacgcaagcctggactttgagacaagccccaagtacttcctgtccattgagtgcagccggaagagctcctcttccctcagtgacgtgaccacagtcatggtcaacatcactgatgtcaatgaacacyggccccaattcccccaagatccatatagcacaagggtcttagagaatgcccttgtgggtgacgtcatcctcacggtaaggatctgccaccttgctctttgtgggacaagaactctgggatgggttcttatctcacccccacacccagccatctatgagcatggattagtttattaagttaatacactgtagacttgactctgacttgtcagaggtttatgtgagatttgagtatggccaaacaatgctcggccaaactatctctcctgagagaatgtctcagagccatatgataagatcagagacaatggaatggggcatgggataggcgaggtttgttaggagaagagagaaaaagagacagaccccagaggactgccagaggctctcaagcctgggaa

SEQ ID NO: 271 - DNA, 601 bp, Homo sapiens
  misc_feature (301)..(301): R = A/G
tagtacacatttgaaacacatcagaatcacctgcatgtcttgtgaaaacacggattgctgggcctcaccctcgaaattttgattcagtggatttagggtggggccagagaatttgaatttccaagttcacagtaatgctgatggtgccgatttgggcccacaatttgagaaccaccattgtagagatccctgttcacccagctttttggatccttacctgtaacagggtgaatcataaagaatcccatgtggttcccactggtgatgttgaaggtcagcttccctttggagctggagtctrggtcccaggcatccagttgaagcacagaggtgcccacgggagcatcctcctggatggaggggtagaacacagcttgggacatctggggtgggttgtcattggcatccgtaacctcgatgtagacttcagttacagaagagaggggcacagaacccctgtccactgctaataccgtcaaccagtagtaagatgcaaattctcggtccaggggtgccagagtctgaatcattcctagggacagtaagtcagcaaacccaaaatactttagagctcaaagtggctttagaaatcacccttacc

SEQ ID NO: 272 - DNA, 801 bp, Homo sapiens
  misc_feature (401)..(401): N = A/C/G/T
gtaggggtcagggccagatgaccccaattctctaagtagcacctctccctcctgtgctctcacagggctctgagacaactcctccccagacacagatgctgcctcgttatctgatgcattgcaaaagagaggacagttataaggggtggggaagagatggaatctctctttctctgaccctttttaaaatctcaaccttcccacctgatcttaatgcccaattctgaaccccatacgctgatattctgcctttactctacacactggaacccaagatctgagagctgcagcccctgcgtagacaaaggagttggctttggtgaagagacgggtgagaaggaagggggtctggagaggatgacttactcaccagctggagagtctgactcctttggactggnggtgatactcctagaagtctctgggaaccaaacaaaggctaagtgtgaaatgaaaccatattcccgccccctgtcactgtgcctactccgaacacacacacacatggggaggcacaattccacagcatttaagaaaagcatgggccgggcacggtgcctcatgcctataatcccagcactttgggaggctgaggtaggaggctggcttgagtccaggagttcaagaccaacctgagcaacatagaaaaaccctatctctacaaaaaaatacaaaaattagccaggcgtggtggcacgtgccagtaatcccagctactcagtggaggctgaggcaggaagatcacctgagccctgggaggttgaggctgcagtgagccaggattgtaccactgcactctag

SEQ ID NO: 273 - DNA, 601 bp, Homo sapiens
  misc_feature (301)..(301): R = A/G
taatgtgacatgtagagaaatatttattttaaaacttggttgtttctaaatttgtattaaaagttcgggtaggtgattgagagaatattgtatcagtcctggctcttgtttcttaaaaagagtcagatatgagatgttctagttaaaccttttatctgtaaagaatttgaaaacttacttgttaaagaggtcaatttatttatattctgttcttactgcttgtagtttaaaaacgaatatggacttatttttatcttttacctattattatttcataaacttttcatatttagttaataartcatgctttgaaagaactcatggaaatagaagaagtgagtgaaaatgtattacaagttcacttaaatggtaagtatgccattattttgccattggagattatgtaaactttgtggggtttttatatgacttgtatatttcaaatccattttaatagttagattttgaaaactagatccatgttttacttagcacaccatatgcagtatttttagaaattaaaataataataatgaaggagtcgcagaaggactctggtttttgtgggttttttggtttttttttttttaatcattctaat

SEQ ID NO: 274 - DNA, 1001 bp, Homo sapiens
  misc_feature (501)..(501): Y = C/T
tggagtccctggcttacctgttgttgtccctggcttacctggagtccctggctccgggcttccctccgcgtgctgctgctcctccaggtcccccccggtggctctcgcgcgcccccaggcggccacgtcgcggagcagctccgtcacgttgtgttgagtgatctccccggccgtctaacagtagaaggggcgtggccagacgtcggggccaggatggcggggcggggcttagaacgctgggagtcctcggtccaggactagaactcccgcagctgcttggaggatgtgaagtggggcgggacctatcccgcggggatggggcctgttctctgaatggagtcgttcccaccaagcgacgggcggggtctggagctgggggcggggcctgctgtgggggcggggccttgcgcacccaccgacccccagccccacctctacccccagtcccagcctcgccgcgcaccttgactggctggccgttgctcgtccgcaggaggctcycgtcgtccgcttcgatgccgaaggccacgaagggccccgtggcgatgtccccccagtacccgcgcgctgccacgcgctccccacgctggaaaaggagggagagaggaggcaggtgaggtcgatgttggggcccctgactcctaggactccgagcagcagcagtgggccaggacaggcagtggacacgcacgtagctcaggaggcgaccggacgccagggtccggttgggcacatgataggcgctggagtccctgagttcaaaggcgacgcctgtgtcccgccagcgtcggaactcctgggggtgaatgacttgagcctggggtggggggcgggaagaagggagccctcagtgaaccgagcgtggagagacccctacaccagcctccctcagacccaggagtccaggtccccaggccctcctccctcagacccaggagttcaggcccccaaaccctcctccctcagactcaggaggcccccagcccctcctccctcagacc

SEQ ID NO: 275 - DNA, 746 bp, Homo sapiens
  misc_feature (501)..(501): K = G/T
attgattcccacatccagtgagaccaactcacgggaatctaaagggaatgatattacaatttatgggcatggaccttatggacttgacatttaaccacactttgcagatcttacctgcaacaggtaattcttctgaaatagaaaatcaaactcagaatgccatggatgtaacaacaggttatggaactaaagcttcaggaaataaaacagtttttaagagtaaacaaaatactgcttttcaagacctttccataaactctgcagacaaaatacatattaccagaagtcatattatgggggcagaaactcacatagtctcacagacttgtaatcaggatgccagaatattagccatgaccccagaatctatatattctaatccatctattcaaggttgtaagactgttttctattctagttgtaatgatgccatggaaatgaccaaatgtctctcaaatatgagagaggagaaaaatttgctaaagcatgacagtaattatkctaaaatgtattgcaatccagatgctatgtcttctctcacagagaaaactatttattccggagaggagaacatggacattaccaagagtcatacagttgcaatagataatcaaatttttaaacaagatcaatcaaatgtgcaaatagcagctgcaccaacacccgaaaaagaaatgatgctccaaaatcttatgaccacatcagaagatgggaaaatgaatgtaaattgtaactcagttcctcat

SEQ ID NO: 276 - DNA, 1003 bp, Homo sapiens
  misc_feature (502)..(502): Y = C/T
gattatccccattttatagatgaccactgaggcaaagcaatggggacctcagtcccatcctgtgccctcctttgcccagtaggtcagggctggtcttagggcagagtcgctggctgactctggagaaagaggaagaggctgattcctcaataagccagggagagcccaggagcacttaactgctgagaggcctgctgagggccttttgctctcatttcatgcctgtgtggagcatgagaaacagaaatatgcctatgtcaaggatgcatgaccctaagagccctttcttgggcttgctcaggttcggtggtgagaggaagcctcgcagaatccagcagaatcctcacagaatccagcagcagctctgctggggacatggtccatggtgcaacccacagcaaagccctgacctgacctcctgatgctcaggagaagccatgggcccctcctgtcctgtgttcctgtccttcacaaagctcagcctgtggtggctccttctgaycccagcaggtgagtgtttgtcacctgtcattgtaagacttcatctcatgcctgtgggctcacaaattgtaggaaggagtctgcaggtggatgtgttgcaaccgtcaaagctgcaggggacttcagaggccatcagccaggtggctgtttccactggcagaggtggaggggcagtcacagctctgacgttagcatctgtgtcaccttaaatgtccccaagcttcaatgtcctcagctgcaaaacgcaaatagtgttgtgtacctcccaggcctattgtgaggattaaacgcaagtttgtgaccagaatctgggatacaggaggcactcgggacacagcgctttctgtcccagatggtgctgacacgtttttctgggatttggagctgtagttctcgactcgctcggacagcagagccctgaaggggtgaagctgtttgctgaacacagtgaaaactgacatgagcgatgccatagaaacattttgaaaagttttgtttatct

SEQ ID NO: 277 - DNA, 801 bp, Homo sapiens
  misc_feature (401)..(401): Y = C/T
tctagttaattcacacttcattttattttttgagacagggtcttgctctgtcacccagactggagtgcagtggcacaatcatggcttactgcagcccccaactcctgggctcaagtgatcctctcacctccaccatccaaatagttgggactacacatgcatgctgctattgctctgctaaattaaaaaaaaaaaattagagatgaggtctcactatgttgcgcaggctagtcttgaactcctggcctcaatgaactcctcaaactcaaggctcacacatcagcttcccaaagtgctggaattaaaggcatgagccaccatgcccatcccacactttattttatacttactgaactgtactcaccagcttcctcaaccacaataaatgattcaggtgtccytacaggaagtggaggggggatttcatcatctatccttggagcagttgctatccaaaatgtcaaaaatattgtaacaattgttaattagaacaatccaaaggaaattcttatattctaatattaaatataaatttaccataatttatatttaaattccgttgaagcaacattatcagtaaagttgacacttgttcattcaaggaaaaagcaaaataaattctcttaaggtacaaacccaggaggtttttgcttattctttaacatttattgttttaaaagctcaaaagtagggctgggcgcggtggctcacgcctgtaatcccagcactttcggaggccgaggcgggcagatcacaaggtcaggagatcgaaaccatcctggctaacgtggtgaaaccgtg

SEQ ID NO: 278 - DNA, 501 bp, Homo sapiens
  misc_feature (251)..(251): N = A/C/G/T
acatcagtagcctcaaaaggcacaggactcagatgataaggagccactgcttgacccagcctggccacagaccatgctcagtggtcagcacaggtggcaggtcaaagctggagtgaactaggctgggacctcctcaaaccacctcccctctgcatgctttacaaaggaaacacccagaaagcgggagcctgaggctgcatcccccagccactcccagccacagaccactgtttccatgaggatcagccgcntgtccagctcatgaatacgctcattcttcatctcgatgacaaagtgtaagctctccagctcctgctcccagaactggctggggctcccataatcctagacagggacagagtgacctcattaggccagtaggctacctccctcctccccattctgccagcaactcattgttggactttcacaagtcacccaccttcctctctcagcccatgttaagtgtttaatatgctttatctccctgtatccgaatat

SEQ ID NO: 279 - DNA, 601 bp, Homo sapiens
  misc_feature (301)..(301): Y = C/T
ccctggtcctcagcactgccacagccctcgacctcagatcccagcatcgccaaccatgcctcagtgggaccaacactccaaacaacctcggtgtctccagatcccacaagggagtcagtcctgcagccttctcctcaggtaccagccaccactgtggcccacacagccacccagcaaccagcagccccagctcctccggcagtgtctcccagggaggcattgatggaagctatgcacacagtcccagtgcctcccaccacagtcagaacagactcgctggggaaagatgctcctgctgggyggggaacaacccctgccagccccacgctgagccccgaagaagaagatgacatccggaatgtcataggtaagttcattgtacctggccttggtctcctgatcagctcaggtaaaaggctgagcctggaaatatcttgagaggagagggaggcaccagatggtcaaagttctttatgggaatggcaagtggagttaagcctttgaccaacgattagttttaacatctagggtttatttattgaaaatgtgccagtggcaagggtgggactcttttttcctaaaatagacatataaattaatg

SEQ ID NO: 280 - DNA, 601 bp, Homo sapiens
  misc_feature (301)..(301): S = C/G
acagtgaaggcgagccccggtcccgcgcggtaaccaccagctcgtaggcggacacactctcgcggtccagagctctgtccagcaccaacgagtagtaattcttgtaggtggacaccagcttgaaggggacgtggggcgtcagggagcaggtaacctgcccgttggcatctgcgtctaggtcgatcacactaatcagggcaataactgtccccagttgtgcgtcctcttttacaggaaccgagagcgttttgatagtcaactgtggagcattgtcatttacatccacaacttccacaagaastgtacaatgaccagccaggggtgggaagcctttatcgacagcctcgactgggatcttgtgtgctctactttcttcaaaatccatatgtcctatcactgtgattgccccacttaaggggtccatgtggaacttggattttatatctggagaaacatcactggagaaggagtaaataatatccccattcaagccttcgtctaaatctgaggcattggggtgaatcaccagcgttccgatagaaacgttttctggtaatttcaccgtatacagggttctgtcgaacactggggcattgtcatt

SEQ ID NO: 281 - DNA, 801 bp, Homo sapiens
  misc_feature (401)..(401): R = A/G
agtggtaaaccataaattaataatttcgcttaaagctgagcacgtagtaggtgcttttagaagtttgttctcctctcctttcctttcttccaggtctgccctggcacattgctctggttgggaattccacacaaacttaataaaattaatggctgaataaagtgggctagaaggaccttcgaggccatcctctcaccctctgcctgtccctgtttcttaggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcrttgattccctgaagaccaagcagaacatgccacccaggcagctgctggaggtgagtcccttgggggcagaattgcagagaggtagcagcccatccctagtctcaggtcagagcatggaccactggcagaatacctgagattgccccaaccatcctacctctagcccagtgctgtccaatagcaatatgtgagccgcatgtattagaatgaaaatgtgagccacatatgtaattcataaatataattctggccacatgtgtgatttagaaatgtagtttcagccacatatggaattacaaatttttctagttagtcacattaaaatgataaaagtgaaattaattttaataaaatattttaactcaatatatctgaaatattatcctttcagcctgtaatg

SEQ ID NO: 282 - DNA, 801 bp, Homo sapiens
  misc_feature (401)..(401): S = C/G
gagtggaagggtgcactccatggacggcccccgcccctcacccgcctcccgtgctccttccaggacactctggaggctccagcctcccacccacagggccgccctccacacctggtgagtcactgaggcctcgtggggagcgccgcctcccccagggcagtctgagtctcccaaaggatcccactcccctcccctcaaggacgggcttgtgtcccaggggctctgaggctgggctggtgaagagtggggggtcgaggcagagggagatgttggggcccagccaggaggaggagccgggctgatgtggggggcaagacagccccagccttcacctccctgtcctgacccaggaggtcctgaggaccagccccttaaccccccagggtcaggccctcagaatsgtgagtgaggggctctgagtgggagatgggcggggtccaggggaggcaggggtgggttctgtcctaggttcaggctcctctggaggtggtgatgtggacaggcccctcccctgcctgggcctcagtttctccaagtgtaaaggagagaggcctgtgggtgggaaagttcctttcagctctgacccccagctgtgacctcctgggagaggaggcctcccagggaacctcccagacccgattccacaggggcctgtcccgtcccacctgcagcagtgacggtgacctggggcaggggaggggagcagggccgtggttcaggacggtcaggctctttccctgcagctccgggtctcggctctggtgcaggaacaagggctgcaggtcagactcccgggctccc

SEQ ID NO: 283 - DNA, 601 bp, Homo sapiens
  misc_feature (301)..(301): R = A/G
ttaaaggctgcagaaaacttcactcttttggttaagaacaacatctggtatcccaaatttaatttcagcaagtaagtggtggccaggtgtgtgagttcaccagggtcttggagaaacttctggctcttctctcttctctgaggttttcgtcgctctgattttctgcttcctctcgactttaggaggaatatccttcccaacatcaccactacttacctcaagtcgtgcatttatgatgctaaaacagatcccttctgccccatattccgtcttggcaaaatagtggagaacgcaggacacrgtttccaggacatggccgtggaggtgggtgcgggccctggctctcctgacccagccctggaggcgtctcgtgccaggtgctgaggaaagccttgccgtgtctctgctgctcatccccagggaggcatcatgggcatccaggtcaactgggactgcaacctggacagagccgcctccctctgcttgcccaggtactccttccgccgcctcgatacacgggacgttgagcacaacgtatctcctggctacaatttcaggtgggcgtgagcttgggcccctcgctcatgttgtagggggtgct

SEQ ID NO: 284 - DNA, 638 bp, Homo sapiens
  misc_feature (355)..(355): R = A/G
gctcctggggagagagcagaggtctaggaggccccatccaacccctgtggctcccgagtggcacgcgttcgaccccaagaccctacactcaccatggtcgataagtcttccgaacctctgagctccggacaggctctggaagtgctttagcttctttcctacacagcggcacccgccggcttccaggcttcacacttgtgaactcttcggctgcctctgacagtttatgtaatcctgggatgtcattcagttccctcctctgtgaaccctgatcacctccccacctctcttcctccgagccagcccccttcctttcctggaaatattgcaatgaaggatgtttcagggagggggrccgtaacaggaaggattctgcagggcatctagggttctgtgtctcctggcagtgtcctgatgactcaggcgccccaggcggtgaatgccctgttgactcgggagcctaagccttctctggtgggtgtgggaaaaggatgatcctcagtgccttaggccagtaccatactctgcactatccaaccccccaatccccctaccttatatcccagagaatctacttgattcatttctttgacttcttccttgtcttggtttatgttgatctcctgccaccaatccaa

SEQ ID NO: 285 - DNA, 801 bp, Homo sapiens
  misc_feature (401)..(401): N = A/C/G/T
cctctggaagaatcactggatcagatgttcggttctcagcaggtccatgggttccaagctgcccatctgctttcagaacctatgctgagttcgagatttatggaggagcccacatcccgagctgtgtttttgttccaggctcttctctagacctcaaaccaggagccagccactacattgggttctatacagagatccaggttctcagctcagctctagggctttagactctggaattcactaggtacagggacaggggagggggtcacttacgggcggccgcagtgagcagcagtgatgacccactggcctgaaagcagggcgcctccgcagaggaagcggcgcctgggacccgccagcagggccgcctgccacggctgggagctccgggtgcacgtatngccaccaattatcttgttctcatcctcttggctctgtgtcatggctaggagtggacaggattgggtggggaaagtagatgagcaaacactctccactccacaagtttgtaggattccaaaactgacaaatccccttccttttggtctaacccctaaactgcccgcctctatctgtcccacccagggtgagacatgcccaatattgaccccgttattgccccagcacggagagctttctgactcacctcccaagtcacctccgtagcatctcttattttgtgccgtggccaccttatccagggccttgctacatctacgacccttagctctatgctcccataatttctgtgatcacttctcgaaatatgccacatttccccccaatgagtccttccccaac

SEQ ID NO: 286 - DNA, 801 bp, Homo sapiens
  misc_feature (401)..(401): R = A/G
aatgtgcctgacctacccaatcctcagctcagctgctcataagaagcagctgaggagatgtatctaaggaacagaaactctgtttttggtgggggagagagaagtcagggactatgtcctgtttcttttcatctctgcaactatctgtctgtaagatattttccaccttgtttaactcacagccacaataatttcaaatatagctttaattatgaatcaccatttggtataaagatgctcatctttattcacttaagccactctaggtcctcttattggaaacactttacatttttcttcactgagattcaggctattctatcattccctcacagttccaaaaaaaaccagcttacctcacaacttaatgcaggttcttccaattctgatggtagctgatrctcaggaaaaaaatacagaagaatctccctaggaatacaagcacagcagatatgggaatatactaggataacagaggtagcactcaactgtcagaactgggtttgtctcctgggtattaaatatcctggcaaagatgaacattagttccccccaaacattttgtttttatcactgacatcaaagtgttcttcagaaagcatagactggggagaggaaggtgggtgtggctataaaaaggcaataggagggaccattctggcaaaggaactggtctgtatcttgactgcatcaatgtcaatatcctgattgtgattctgttccagagttttgcaagaagctaggtgaagggtacaggggatctctcagcattatttcttacaacttaatgtgaacatacat

SEQ ID NO: 287 - DNA, 601 bp, Homo sapiens
  misc_feature (301)..(301): Y = C/T
ccacccctccccaggcacaaagccctgctgcatgtggagtccgaagaatgcaggcgagtatgggggcacaggtttgccctctcggggcgcttttgtcaagagtcccatggactagagtggctactggcttccacgggaaggatggcagccccaggcagcccacccaacagctctgtgccttaagaggtggggagggcagaagactagggcacccctgtacccagggctcaggcctgtgacccccagtgctggcaagaggaacgtgggccaggagagttgtccaggtaaaagagatagcagygggaaacaaaggtctttggctgaagcatcctaggacacctccccaacgaggagaaggcatggctgtgatcacagggagctcattaaagctcaaggggacaccacgctccgggacagggtgtgtctgacatgcaggggtctttgtgggttttctcctgaattccatgtgctccatcctccaaccactttctctttctgcatttattaaaattatgacccaggatccgggtgcagggtgggcgggtgtttatgtgaggtggagaagggctgagaaattcaacgcatcctttttccgagcact

SEQ ID NO: 288 - DNA, 452 bp, Homo sapiens
  misc_feature (252)..(252): S = C/G
caaccaaacacacacacacacacacacacacacacacacacacacacacacacacacaaggtgattgctatgcaaattaaatatagcttcaccaatcagcttgcttctcctaatccctcatagaaatcttggagtagccctggggtgcagtgaggccagattccaggaagggaatgggtgggatgggtctgggtactggtgagcagcagggagggtaagtaggttagcttctgggccaaggagggctcctgsaggcttgttctgggtaaaagctggtctccttgaacctcggaaggtgggggaacccacatcctggtctcacccgcccaaccgcccactcacccttgggttagcagccatctaagccccaccctccccctcacacgcttagctagcctgccacaagctggccccttggcctcctagagaccctgacatctcctccagcagca

SEQ ID NO: 289 - DNA, 801 bp, Homo sapiens
  misc_feature (401)..(401): K = G/T
agccttgatcttcttaaattgaagctgtaacatttccttgtcattcctggattcctgaagatgtttttgcgtgttagctaaaacctcttccaaattctgcaatgtctttttagtatcattcttctctaggattattttgtatttgtcttcaattaattcttcaacattctcctttagcttattgatgacatcaatgaacacttgctgtttggtaatcttcatctgtagttctttaaccctcttctctaaatacaggttactacactggagttcttggattcgcacttcctgctttctgttagtatgttttaatttctgcaagacttcatttaaagccatgtcctcttgaacaggttgtaagctttcagcactttgctcccagtcaggcatctcacagttckcccgacatgcttcactcctccaggaaatgcctgccgaagaccaagttgagacaatttctggcctctccacaccctctgctgtgacttccttttcataactgactgacatctcaggaatctccccataattctgtatttcttttgaaggaactgcagtctgtaaattatagtaaacaaagtaagtgtgaacgagtagaaagataatgagctttcaagtcaaatagggctggccttgaattctattagtagatcccctgtttggctttctccgctataaagtaacaatagtatctacttccaataataatgcctattaacaaaagttaatacctatgtattaattgctaaatgtttgtacagcacctaacagcacagcagggcacaggcagtaggtatatga

SEQ ID NO: 290 - DNA, 601 bp, Homo sapiens
  misc_feature (301)..(301): Y = C/T
accattacacatgcacatttcctgctttgtgaagtgttcttggtactaaatctgtatccttttctatgtaaagaaatttatttcttgacttgaagagtatgtatttgaagtgatcaaaaatactactttacaggcacctcacgataagttcctaattataaatgtattcataaacacaggttttatttttcattctttatcagaaacccaaattattctgaaatgggggattttcttcgacttcactacctgtgctctggggtaggaagttggggataattggtttcagaaatttgaactyatttgacctggagcctccagtcacacacacctcatagtggtagctctgggacagggtcccggtgccactcacgtccaccagatgtcctggaaaggggccctcaggcaccgagcagcgaccgaccggggccgccctgctcctcctgcacagccgcaccgccacgaacaggagcaccgagaagaggaagagcgacgacactgaggccaacgccaccaccaggtagacagtgagcgagtcggcctgggcctgggccggggccgcctccgggagaggcaggtagggctgggagaagccgtccac

SEQ ID NO: 291 - DNA, 501 bp, Homo sapiens
  misc_feature (251)..(251): S = C/G
gcaattggactatgaggcaattcaaacttacacattaactattcaggccaaagacggcggcgggctttctggaaaatgcactgtagtggttgatgtaacagatataaacgataatcgacccgagctgctcctgtcttcacttactagcccaattgcagaaaactcacccgagacagtcgtggctgtttttaggattagagacagagattccgggaacaatggaaagacagtgtgctccatccaggacgatstccccttcatcctgaagccatctgtcgaaaacttctatactctggtaacagagaaacctttggatcgagagaggaacactgagtacaacatcaccatcaccgtcaccgacttggggacacccaggctgaaaaccgagcacaacataaccgtgctggtctccgacgtcaatgacaacgctcccgccttcacccaaacctcctacaccctgtttgtccgtgagaacaacagccccgccctgcccatccgcag

SEQ ID NO: 292 - DNA, 401 bp, Homo sapiens
  misc_feature (201)..(201): K = G/T
aagccatgttctgctcttgagcgagcacccactgggcctcatgcaaggtagaaaaagcctgcgtacgtcaccctcccatgatgtggtcaacatgtaaactgcatgggcagggcgccaaataacatcctgtgcgctgctgagctgagctggggcgcggccgcctgtctgcaccggcagcaccatgtcgctcatggtcatcakcatggcgtgtgttggtgagtcctggaagggaatagagggagggagcgtggggatggagatctgggcccagaggtggagatatgggcctggaggtggagttatgggcctggagtggagatctgggcctagagatggagtgatgagcctagaagtggagatctgcgcctggagtggagatctgggcctggagtgaagatctg

SEQ ID NO: 293 - DNA, 558 bp, Homo sapiens
  misc_feature (201)..(201): R = A/G
gatctttttcctaaaagagggagaggaaggaaaagtaagaagaaaagaaagcagcatgtagttcttttttttcccctttccctttaaccaaacccttatttacttgtgttctttaaaagctattattagtgttatttattattagccatcagaaatttaaaaatttaacatatactcagagacagcaaatatgtattaccrtctgagaatttggttcctcttctccccactggtgttttggagaattctgcatcatgaaagaagaaaaatcattcataatctcattccacttaatccaattaactttattattaagataataaagtattattatcttattataaataatatatttatataataaaatatattttattatatattatatttatattatatataataaatatttattatataatatataatatgtaacttataaataagtattaagataataaaacttaattctaactgaacaaactctcacacttctcagttataatgagcgcaaaaattctgaatacaagagtgccattgtaaataattttattacac

SEQ ID NO: 294 - DNA, 801 bp, Homo sapiens
  misc_feature (401)..(401): R = A/G
atgtggttaatgccatggacagaagaaggcagcaggtggcagaatggggtgcatgaaggtttctgaaaattaacactgcttgtgtttttaactcaatattttccatgaaaatgcaacaacatgtataatatttttaattaaataaaaatctgtggtggtcgttttccggagttgtctttatcatccttgcatttgaatattgtgttcaaatttttgattgattcattcagtatctggtggagtctccaatattagaaatactggaaacaaactgaaaaaccacaaaaggacaaataatgcttcatgagtcagctttgcaccagccattacctgcaagtcattcttggaaggtatccatcctctttccttttgatttcttcaccactatttgggatataacrtgggttaacacagacatagcagtcctttataaatcaattggcatgctgtttaacacaggttcttcacctcccctttcttaccgcctgctttctcagctcaactatcacaggcattacagttgtcatggcaaccccaatgttggcaaccacgtcccttgcagccattttgatctgccttcctgaaatatagagcttttccctgtggcttccaaatgaactattttgcaaatgtggggaaaacacacacctgtggtcctatgttgctatcagctggcacacctaggcctggcacactaagccctctgtgattcttgcttaaccaatgtatagtctcagcacatttggtttccacttaaggtttcctatttttgacctccacatcctgttattgtcttttgca

SEQ ID NO: 295 - DNA, 801 bp, Homo sapiens
  misc_feature (401)..(401): R = A/G
tacagttacctgccaccatgcccagctaatttttgtatttttagaagagacagggtttcaccattttggtcaggctggtcttgaactcctgaccttgtgatccgcccgccttggcctcccaaagtgctgggattacaggcgtgagccaccgctcccggcctgtgactttttctttgacattattgataatgtaaaccttgggagttaaaagtgcagggacaatcactaataggtcagagattctttgactcaagtattgaaacagattcccagaatattggcaaagtctctagctgtttgatgagtgagatgaactcagactgaatcttggcatccctccctccgtggttttcacaggaaatcttcattttgactcattattactcaccactttgcttacrtcgtgcccatcttgttaacaaaatagccaggatggcaagtcccagtagagtcaggatgacagccaaagttatttctgaaaacaaaaactcacctgtaaacatgcttatttagaccaggaaattaccagaaacaacttctgatcacctcttactatccaccagatagactttttttctttcccctttctgctacttcaactcctttattcttttatttgccgcatattactgtcctcacattcccgcccctgcccatttttagctcttacattggttctttggtcgtatactaagaacctcagatgctgtgtacccttggtttagagttggaaatctgacagatttcctcctcagttgaaccctttactccccaggcaggaagaatgttaaagggaatcag

SEQ ID NO: 296 - DNA, 801 bp, Homo sapiens
  misc_feature (401)..(401): Y = C/T
ggtcgtgagcacagggccagcagggcagaggccagcagctccagaagatgcagggtcaggttggtggagatctgcagacactcttctgggccccccaagtaccgggagggagctcctggttccccccgcagccagcccaacagcttctcacgcctaccaggtttctccaatggggctcctggcccagggacgctcagtcccccttcaggggacacccctggtctcctggtgccacctgaatccacatgatcccatctgagtttgggactggcccctccagcctccagtctcccagactcttgagtgctagagataggctggtcccacttgagggaatccattcttttgctccctagctgctcaacttggggctcctccttgcttggttcggaagcagcccyagaaaccctcaatgcccccgagtccttagtcttgggatgccccacatcttccatggtttctggggcactatcccagtcacttcctgaattctccgaggagctgtccacccgtctgggttctgggtaaggcgggtcaggcctcattggtttccggcggccccaagggcgaggtagccagccaccaagccgtcgcaggaacatggctggggtgtgtaatgggcccccaaattctgaggctgcttcctggcactactcagactctcaggatctcctcagaagccagagtctttctggctcagaacaggtatttgcctggtgatgcagtcctactctgaattcagaagtggctcctcccttctctgaatagtcatgcagcctcaagtgtggcaagtagtttgct

SEQ ID NO: 297 - DNA, 801 bp, Homo sapiens
  misc_feature (401)..(401): Y = C/T
ttcaggcgtcagaggtgctctgagagcatttcaggggtttcccagttgagaagctgatgggggtgttactcaatggaccatttccacacagtagagggaattgtaaggggtggtgatctggctgaggggcactgtggtggaatgggaatttaaacagtaggagagaatcaagagaggagctttgaatctaccattttgagaagaggaaggaggaaggggtgataagagagagtctgcaaccttggggtagtggagaaagcagaaccactcttttgggaaggagggaaactgagctaaccctatgcctgggcactggacttctcccatatgggatatagtgtatgtgcttgtttgtgcccaaggcatgcacacacacaacagttgacttcttatggactgtygagtaactctccttggggtaggaaaacttcagggtcagctagctggggccccagaggcttcacttgggctaggatatcccggatggagcggcaggggatctttccagcactgctggagccacagggcttggcaccagcggagggatcaggatggggagagccatcggggcccccagtcagtgtcaaggaggagacagacatgcaagggtgaccagaagagctggacttgctgccacaaggctgaaggatgattttgccactggattgggaactggagctgctgctgaaggagccggtgcctggtggggagcaggggctctgggaagcactgccgcagggatggtagggtaaaccggagctgctggaaatgctagaactgctggggactcgagaactggag

SEQ ID NO: 298 - DNA, 801 bp, Homo sapiens
  misc_feature (401)..(401): Y = C/T
accattgctacaggggggaccttgaaccactccaggggcaccagaaccgtgctggtccaccaccaccaccacaggcctctgaccccctgacacagagtgggagctggggatgtaggggccagagtgcgagacgatgggccctccactgcagggagagtcggggatgtccgaactacagggacgctggttggagctgacgctttggccactgctggataccccagaggtttgggaagaggaagagctttgtccaggctgggaagggtttagtattccgcggtaagagttgtcattggttggcagagcagagccattccctacttggaagctgctgctgctgaactgaaagctgctgctgctgctcgaatgagagctgctgcttcccgagtgagagccgctgyttcccgagtgagagctgctgctccccagctgggaggaaccggatgcaccttgtagactagagccagatccggaggagtagctgacctgggaataccccgttcctggcttaaaagatcctgcagaaccaccctgggcaatgctggatccgctggagctaccactggagccaccaccagagcttctggcactggaaatggagctgccagaactgctggagccactgtagctactgaagccgctggagtcacccttcccagtgaggcaggggtcgttaggggaggtgatacgcgtggggtccttacaggggtctgagaaggtgccaatgctcttagccaaggtccctgtggaggaaagcagtggttagtaagggccaaagaggcttggcttcctccctcacct

SEQ ID NO: 299 - DNA, 801 bp, Homo sapiens
  misc_feature (401)..(401): N = A/C/G/T
ataaaaagacagctgttttcaaagtgggcttgaagatgtcaagatctaggtatctagaaaatgcacttacatggactgcctcattcccccaacatgccataaaataatagtagctaatatttgcttaaggcttattatgtaccaagtaccattttaaatgctttcatctttatgatatggttattagcacctgcggggagggaggttaaaattgggctaaacagagtgaggcatcctgggacatcccaacatgttctggcagcttcaagctttggtacctcgtctgcaaacagtgggctaacaccatgttcccaggcagtaaagctcccctaaggcagttcctcagtctgttcgttcttatttacatcctagaagtcagaggcctcaccagggtgtggacntcttgtgctctgctggatctactgtgtacgcaccattcactggaatgattgtgggccaggagaaaccttatcaaaacaagaatgctatcaataatggtgttcgaatatctggaagaggtaagagaggtggagtctacacctggggtgcctcctggagatgttgatgctcatttatttaatgcaggttccatacgtagagattttgtacttctttcaaaatgataaaacctggaacagaaagaatatagagtgtacccaaactagctgatgcattttttaaaaaacttttattttaggttcaggggtacatgtgcacatttgttatataggtaaaccacatgtcacagacatttggtgtacagattattttgtcacccaggtaataagcatagtacccgat

SEQ ID NO: 300 - DNA, 601 bp, Homo sapiens
  misc_feature (301)..(301): Y = C/T
tcagcactcagtacatgttccctgtcaggaaggcagggaggcctcactggcagcatcaggacatgggacatcaggacatacaccgtggctctcagggaaaggaaagagaccctctcccaggtgtacaagctcgattctaaacctcatgggaccctgcattgttcgctccctcattcattcactagtccatgcgtgtactcagtagtggcataagcagactgctcgggtcggacctgaattagcctcacccactctcctcctacactgtccctccccagggcacattcgcctcccaggtgaygctggagggggacaagttgaaagtggagcgggagatcgatgggggcctggagaccctgcgcctgaagctgccagctgtggtgacagctgacctgaggctcaacgagccccgctacgccacgctgcccaacatcatggtgagcccctggccagcgggcactgagggcctgggggtggcaagcacattgccagcccagtgccccccggtggtcgcacgtggggagggaaggatccaaaggaggtctcgtgcacaggaagccgtcacctggagtttggctgatagagagagtttgctgggtca

SEQ ID NO: 301 - DNA, 801 bp, Homo sapiens
  misc_feature (401)..(401): Y = C/T
attaaaaacaagtaatttcaagagtttcaaggtatgccactaagtttcctataagtgttacagaatattagtattggtaatttcattccaaaagcaaataaatgcctatgactatatgcttagtgtattttatacgtaaaaattttagcatatgatttttatgctatgaatttacaaataaacctttcctgattatttaaatcatctcagacaaaaggttatctatgtctaaagaaatgactttgagtactaaaatgtaatcacattaaaatattttttttctgacctccttaaagcttcttgccagccctggtcatgcagtggccatggagaatgtgtagaaatcatcaataattacacctgcaactgtgatgtggggtactatgggccccagtgtcagyttggtaagtctctttcctttctttgcttcttcttaggtaaagtcacaggaatcattatagcttatcatgaagctggttggaacaaaatgatactagccactctgagaaatgggaagttttgatcagaaagctctgctttcacaatattgttacctttccgtaaagatttcataagtcagcatgaagtttcgactcacttctcaacaagtctttttgagtaccacaagaagcacagtgttgggataaaagctgtcagggttaccataaggaattagcatggtagattcccgctctcaagaagctcacgatctaatgagcttgttagattaattagaactctaaggtctggaagaaactatgccatttatcattaggaggctgagttacccagaaagtatct

SEQ ID NO: 302 - DNA, 801 bp, Homo sapiens
  misc_feature (401)..(401): R = A/G
gggctccctggggctggagggcacagccagtggtcacttcaagtcttgaagtgtctcagaagctccagaagcaaagagtccattgaggaacatgctggcaattctgtgacattccctgtcagaaaactctatagacctactcctgaactgaacatttgatggtgtgtctctctggtgccatcttaataccctttctcctttttctgtgcagaatttaaatgtgagtttcaatcctgaaagtttcctggactgccagattcatagggtggatgacattcaagctagagatgaagtggaaggttttctgcaagatacgtttcctcagcaactagaagaatctgagaagcagaggcttggaggggatgtgcagagccccaactgcccatctgaggatgtagtcrtcactccagaaagctttggaagagattcatccctcacatgcctggctgggaatgtcagtgcatgtgacgcccctattctctcctcttccaggtccctagactgcagggagagtggcaagaatgggcctcatgtgtaccaggacctcctgcttagccttgggactacaaacagcacgctgccccctccattttctctccaatctggaatcctgacattgaacccagttgctcagggtcagcccattcttacttccctgggatcaaatcaagaagaagcatatgtcaccatgtccagcttctaccaaaaccagtgaagtgtaagaaacccagactgaacttaccgtgagcgacaaagatgatttaaaagggaagtctagagttcctagtctccctcacagca

SEQ ID NO: 303 - DNA, 601 bp, Homo sapiens
  misc_feature (301)..(301): R = A/G
gggctccaggctgggacccctccgtggggagctctgcggcaccacgctttgtgaatgggccctggggggaggttccgctgcctggggccccgatgcggggagccgcccttgaggcccccggagccacggaatagctgtcgcagggcgtggaacccgtgggcagccgcaggtgtgctcttgggggccaggacgccaggggcttccgaggtgttcacacctgcaaaccgccccgacctggcccccagactccttcctccgatttttggaaagaagtgcagctggcgctgccgcggaaggtgcrgtacaggcctgtggaaggagacccccagacgcagctgcaggacgacaaggaccccatgctgattcttcgaggccgagtccctgagggccgggccctggactcagaggtggacccggaccctgagggcgacctgggtatgcccgcccagccccactccccaactggagaagctcagcacagggcggagtgggggcaggcacagggcacagggcctggaggggctccaggtgttgaggactcttcccggcaccgggagcccctgcacggcctctgccctggaggtgctcggccctcggtctg

SEQ ID NO: 304 - DNA, 801 bp, Homo sapiens
  misc_feature (401)..(401): M = A/C
tgaagcccaagtctcttcccctcttcatgaagaagccaggggtctggtcttctaggtaagcacagccatgtggccctggctgccaatccctgcggagcatcttcttggaagagtgacctggggcaagtgacttaccctctgtgggcctcaggaccctctgtcccccatgccgtactctgagcccttagtattccagtgagagggaaaagggctttgggggtcttgaagagactgagacctctcaactcccgctccctgcccccaccagcctccgctaccacaacctgcacccagactacatccatgggcggctgcagagcctggggaagaacttcgccttgcgggtcctgcttgtccaggtggatgtggtaagcaggggctgctccctagccagcctcacmgggctttgaggttgtgcagtgggctgttgaatcccttccaagaggaaatgcagctaaaacctcagcgaggaacgtttttcacatctgagatgacatgggtcaccaagacattatgttggcaaggagaggggagggcaaaattgtctatttcctctttccccacatccccttcaattagtcccagatctctgccacctaaatatctcttctttttgttttgtgtttgtttgtttgtttgtttgagacggagtttcgctcttgttgcccaggctggagtgcaatgacttgatcttggctcactgcagccttcacctctggggttcaagcgattctcctgcctcagccttctgagtagctgggattataggcatgcaccaccacgcccggctgatttttgtat

SEQ ID NO: 305 - DNA, 601 bp, Homo sapiens
  misc_feature (301)..(301): Y = C/T
gaatagaaaataaggctaaaaaaaaagaaacccacaaggttaatgtatactaagtagccaatgtccaagatagtgattctggggactagcttgggtgagaacagtgggaggaggtcatagtggatagaaataggaaaaaaaactaactttatagaattatatctatggcaaataaaagagagaatatgatgaaaaaagtactcagacagccaccgtccttgttgattgataggcccttttgggtactgtcactcacccagagttttaggagtcactgtccaagacaaggtttgtctctcayttccacagatacaataggattcttctccctttgtattttgggaagctaggaaggctggagaggctttcagctgcacactgacctatcaccccatgtgaggcagagacagaaatgatcagaatatggaacgacatgaacacatagaattggggccaagtgtgagatgctgcagtaaattgggatttgtaagaaaaatgtatgtcacatagattcatccatgctttaagaagcatggcaatggcaatgatacaaatcaagattggttgtgtattaggaggatttggcatttgccttagggta

SEQ ID NO: 306 - DNA, 601 bp, Homo sapiens
  misc_feature (301)..(301): N = A/C/G/T
gcagagaactatcactggaagataattccactatattttccccataacttttatcttcttcagttcctgatgctacatccaactcataattctcagtgacatttgtttcattcccatctgtatggaggcaattacctgaagagcactgttctgtctttagaagctctttttctctacagctctgctcacagtgtggtacagtactggatgctgcaaaagaatctacagtaagaattctctgcttatccaagtaagattttgaagattctccctcactatctgtcactgcagcggctgatanctgaggaatactgtactttttacttgctatcaaagttaggtttaatgggcccataaggaagtttcctgtaataatgttttgtttgggtctctcaataggatctgtccactttacttccaggtttcttttacaatcagataaaataaggttaccttgttggtagagatcatttaaaaagtgcttcacatttgaatctaagactgatataagtacgtcagttttcgcctttgtgtgacctatgcaagttgcatcacaatcgttgcctgtactagaatttatgttttcttttatgcaacttaa

SEQ ID NO: 307 - DNA, 601 bp, Homo sapiens
  misc_feature (301)..(301): N = A/C/G/T
tccaactcataattctcagtgacatttgtttcattcccatctgtatggaggcaattacctgaagagcactgttctgtctttagaagctctttttctctacagctctgctcacagtgtggtacagtactggatgctgcaaaagaatctacagtaagaattctctgcttatccaagtaagattttgaagattctccctcactatctgtcactgcagcggctgataactgaggaatactgtactttttacttgctatcaaagttaggtttaatgggcccataaggaagtttcctgtaataatgntttgtttgggtctctcaataggatctgtccactttacttccaggtttcttttacaatcagataaaataaggttaccttgttggtagagatcatttaaaaagtgcttcacatttgaatctaagactgatataagtacgtcagttttcgcctttgtgtgacctatgcaagttgcatcacaatcgttgcctgtactagaatttatgttttcttttatgcaacttaaagatacagaattactttcatttattacttcattagcgtcacaactgttttctttagttgcatctttaacattatgat

SEQ ID NO: 308 - DNA, 501 bp, Homo sapiens
  misc_feature (251)..(251): N = A/C/G/T
gggtgactttttgagacactgctagccatacttttcctagaaaggcattttttctctccacttgttttataagacttgtgctttgacacatgggttaatgatttagaaatatcagcttttggagctcttttctttctccgtttgtcatattttctttttgacgaaaaatgcttagtagaataatattttctttgagacacagaactataaccttgaaggtcacaactttcccagaaattattgcatattantgcatatgattttggtaatgggccctttctttcttctcctactttagttataagctgcaaagatgtgtgaactcttctatgagctttttttaagtgaacaactgctttgtctagttttctggaaagacatttgcttttacataaagatgcttcatcacttaggatatttaggacactcttaatgtgcttttctgactgtgaaaatgttttaattcgtccttgggataatgaagagaaacactcagatgag

SEQ ID NO: 309 - DNA, 601 bp, Homo sapiens
  misc_feature (301)..(301): N = A/C/G/T
aagactgcgagtcctgaaaaatgtgactactgtactcttttgtataagcattaccggactcctgttgggctctctgagccttctcctcactgtggttttggttctcaacctctgacactacatttgacacagaaattgggaaggaaaaattaccttggtccttacattgccctgccatggtaactttattgggaggtatacagtcatagtcctcagagcccatgttgtgagcccaagattgtgaatcattaacagaagttttaaagcaaggggtatccaaaccattagtaagaacagcacnatcaccagggacaacttctgaggaggaggcagaattagatggtgtcgattttatttctgaattaacattatctgaactcttctcaaattgcaaaacctcatttaagcctgcagtactactctgttctcccatactttcttctctcctcatcagtcttgggtctttgatggattttgaagtagtgactgtgcttgagccagtattgttgtgaagaggaaaagaagcattaagaccacttaaaatatttttaagacttgtccaatttaacaaaaggtcaccattaacactgtctttggcatc

SEQ ID NO: 310 - DNA, 801 bp, Homo sapiens
  misc_feature (401)..(401): R = A/G
tctcaaactcacccataatccacctgactcctgcaggttccccactgctccagtgcatccttccgtcccttttgttttctgcactgccagcatgatacacacagtatgctgatattccttcccatgtctgagtcaggtgaggcagaatctagtctctctgtcagacactgaacatgccattgtcatgggttgaagttccacttttttctttcttttttagagagcagctctaaattgggaagcaatgccggaaacaagtctcttaaaaatcaacttggattaacctttcagttacatctgagtgaactgcagctatttcaagctgaaaggaatatttctggatgtaaacatgtcgaaaaacctatcaacaattccttagtttcaccacttcaaaaaatttrttctagtgtcaaatcccacattttaaataaatacagaaatgattttgatgattctccatttctcccacaagaacaaaaagcacaaataagggaaaaaccgtgtgaatgtaatgagcatggcaaagcctttagagtgtcttcaagacttgctaacaatcaagtaatccacactgcagataacccttacaaatgtaatgaatgtgacaaggtcttcagtaacagttcaaaccttgtacaacatcaaagaattcatactggagagaagccttacaagtgtcatgaatgtggcaagctcttcaatcgaatttcactccttgcacgacatcagagaatacatactggagagaaaccttacaaatgtcatgagtgtggcaaagtcttcactcaaaattctcacctt

SEQ ID NO: 311 - DNA, 701 bp, Homo sapiens
  misc_feature (501)..(501): Y = C/T
gaggttcctgttcacacatcgaggatctgctccaaaccccaggagcctgttctttcctaagtgtggcagagaatgctacgtgccctccaagattattttttccttcatacacagtaactagtctcctctgtggcgaggtgtggccatgtgcctatattctggacaaggatttgtgcaacgtctagattaaagggaaggagtgatcctttagcttccctaccttgccccgaccagctggctagaatacggacaggagggcaggagctggaattgccaaactgcgcctcaagatgggagccagttttaaaaatggcaggacacatctgcataagaatgggtccctgccatgccagatttggtctacctacctgggagaaaataaaatctctcgtttaagccactccctatcttgactatatctgagctaccccataccctttccattttcccaccctcctgccttggggcagggtccatttggttacccaggaagttgaaagygatggaaacactgagctggaagagctgctgaatggaagtcacagcctcctcaagggaaagagtttttgatttatcttgttcctgggaaagaaatataaaagactcaccaagggatggtttaccaggattgccacctgcccaagagaatgttatggggatccaggtggccaaatctggataataccttttcaccagtgggc

SEQ ID NO: 312 - DNA, 630 bp, Homo sapiens
  misc_feature (39)..(39): Y = C/T
aaatgaaacaaatggccatgaagcactcatgacaaaaaycaaaaagttgatgagtagtacagagcgacatgatcaaaggcatgctggaaacaaacctattaaaaatgagcttggatcaagctttcattcgcatctgcctgaagtgcacatatttcaccccgaagggaaaattggtaatcaagttgagaaggctatcaacgatgctttctcagtttcagcatcccaacgaatttcctgtaggccaaaaactcgtatttctaataagtataggaataatttcctccagtcttcattactcacacaaaaacgggaagtacacacaagagaaaaatctttccaacgtaatgagagtggcaaagcctttaatggtagctcactcttaaaaaaacatcagataatccatttaggagataaacagtataaatgtgatgtatgcggcaaggactttcatcagaagcgataccttgcatgccatagatgtcacactggtgagaatccttacaagtgtaatgagtgtggcaagacattcagtcacaattcagccctgttagttcacaaggcaattcatactggagagaaaccttacaagtgtaatgaatgtggcaaggtttttaatcaacaatcaaacct

SEQ ID NO: 313 - DNA, 601 bp, Homo sapiens
  misc_feature (301)..(301): Y = C/T
catcactcgtgtggtaagtaaaattgctgctcagaacacttccatgcctgctcctttgtgattcagatgaggagaaatcaacgtggactgagcgcccacacaggacagccaggcatttcccatacaggtggtaaaggtatcttctgaacttctccccagcaaatgcatagatgagaggattcaggcaacaatggctaaatgcaaccgtctcagtcacactgagggccagcctcagatccttcctcatgtcacaactgggaaagaagtcatagagcttaagcgtctccaggaaaatcataaygttgtagggtgtccagaagaggaaaaacacgatgaccaccagaaggatcagtttaatggctttggctttcttgtggttcttgcaggaaaacagcgtctggatgattctgaagtagcaataactcataatgagcagggggagtaggaagccaagaaaatttgtttccacattgcggagcacgggccagatttcctggaggacctcggggtagtcaccaaggcattcattttctttctgctttgtgaacatgaactggggtgctgccaccaaaatggctgctgcccagacgcctaggctgat

SEQ ID NO: 314 - DNA, 501 bp, Homo sapiens
  misc_feature (251)..(251): R = A/G
ggttatgacttaaattaatggtgctctgctgggacaagatagggaggagacggggtgagatgatgttaatgctgttggcagccagattgaggtagattcccttaagatggctaagagaatcaatgctgtcgcatgtcaggctgttgtggcttaagtctacatggctcatttttcccaagctgtggaatgcttgctggtctatagagaggagaccacaagaggacaaaatcagaacctccaagctgcccacrgtctgaagtaggttggtcttcgtgatagtcccatcttgaaagtgattcccttttaagttgagatgccggagaactggtaggcctgctagaagatgctgattgctggtatcaaggaagcagtaagtgagattcagaacctgaaggaaatggaggttttggaagggactttgtggagcattaatgtgtaagcgggtaaatgccaaatcgaggagttctagctgaggacattctttgaatgcctgactctgga

SEQ ID NO: 315 - DNA, 601 bp, Homo sapiens
  misc_feature (301)..(301): N = A/C/G/T
cagcccatctacctctggccctggcaccccaccctaccccacccccagtacctgtatcttggttgatgctgaaggctgcgagtccagtgccagcacgcaggaagtactggagctccccatccaagccactgtcatcgtcctgggcagccactacaatcacctgagttcccgaggggctgttctcctgcacctggccctggtgcacgaaggaggcaaagtggggagggtggagattctcattcacatccaggacgatcacctccacatggcagagagtcctgcgggctaggggcctcccacnatcactggcccacaggctcagattgtacccagctcgcctctcaaagtccagctctctctccagaatgagcgcccctgtcatcaggtccacccggaaggtcccatgggcgccatccatcagaacatatcgcacttcacctgcggggcccaggtcaggatcagaggcatccagaaatgtcaagacagtcccggggggcaggtcctctggaaccttcaacctgttgtgttctgtgatgcactggggagagttgtcgttgacatcctccaatgtgattatcaggtcagtgacagagaagagctg

SEQ ID NO: 316 - DNA, 601 bp, Homo sapiens
  misc_feature (301)..(301): N = A/C/G/T
ccctctgcctgcggacccagaagaagctggcaggtaccagagatgagcaatccagagaccaggaggttaaggaagcatttattgaaaacctgtgatgtacctctggcccagaccaagaggcagagtcaagccaaggcttcaatcagtcacaggagactggggatcttgggcctgacccctactcctcaccagtagacttagctgtatcaaaatagctcctttatttcctgaaagccccttgggctaaggtcggggtggagtgtgtcctcctggcctatgaggacatcaggccctgcttggngtgcagctccaggtctttctccttttaggggcttgggactggcctgcaggaggttagtgtccagggtgggaatttacacccatccccatggccacatggtcccctcctgccccatcaccaccttgggtggacccagtatgggaaaggccctccccatagaccatcctctgaggagtcccaggaccccctcccttgtcctcccgccccttccgctgtcccttcagtagctgtttctgttccctgatgcccacttctggggcttaccacatctcctgggccagcctcttcctcttgtgtgct

SEQ ID NO: 317 - DNA, 602 bp, Homo sapiens
  misc_feature (4)..(4): n is a, c, g, or t
  misc_feature (301)..(301): R = A/G
  misc_feature (399)..(399): n is a, c, g, or t
atcnaaaaaaaaaaaaaaacgtcctgatcccagagyctcttcacgcgtcccctaccacagcacttcagagaagcaggtctttaatcagtgtgtctagatgcagctgctgactgtcacccctaccccgcctctctcccagtctgcggacggccagtcacccccattgcccagaatcagacgaccctcggttcttccagagccaagctgggcaacttcccctggcaagccttcaccagtatccacggccgtgggggcggggccctgctgggggacagatggatcctcactgctgcccacaccrtctaccccaaggacagtgtttctctcaggaagaaccagagtgtgaatgtgttcttgggccacacagccatagatgagatgctgaaactggggaaccanccctgtccaccgtgtcgttgtgcaccccgactaccgtcagaatgagtcccataactttagcggggacatcgccctcctggagctgcagcacagcatccccctgggccccaacgtcctcccggtctgtctgcccgataatgagaccctctaccgcagcggcttgttgggctacgtcagtgggtttggcatggagatgggctggc

SEQ ID NO: 318 - DNA, 801 bp, Homo sapiens
  misc_feature (401)..(401): Y = C/T
caggcagaaagtgggagacagaatcaatgggatgccaattgagagcacttcatgggatggggtcttgaactcagagagatagaatgtctgagtctggatgttggcagctgaagagcctcaggcacctacagcctccccctgtgggttggtgtctgcccatgaaatgaggacccagaagggccctccaagcggttttgatgacttccgtctcctacagatgctgctgtaatggaccaagagcctgcgggggacagaacagtgaataggcaggtaggtcctcctcggcccagcctcacggatacagtcttatccctaatagtcctgaaaaatgtgagcaccctccctcactcagcatttccctctctccaggactctgatgaacaagaccctcaggaggtgaygtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgc

SEQ ID NO: 319 - DNA, 801 bp, Homo sapiens
  misc_feature (401)..(401): R = A/G
gtccaagtcattgatcgtggttctcatagtttgagagagaagttctgagagcaaaaagcctggacaggatgatattatgtcattgaggcctaaccatcatcactctagaacactttttctgtattaaagcatattataagtttcaaagagctgacttacaagtaatggattaataactaactttactaactttacccatttgaagactggcatgctgaacaacccaatatcatttcattctgagcaagaatatcattcccagaaaaaaccaggaggatttgtatcacaacgtaccctttcatttacttgatttatttgtgttttcaggcccgtggtcgagccagagctgatgagagcacctacgtcctggttgctcacagtggttcaggagttatcgaacrtgagacagttaatgatttccgagagaagatgatgtataaagctatacattgtgttcaaaatatgaaaccagaggagtatgctcataaggtattgttggtcacctctgaatttgattttcatttaaaaatggcggcatgtggttgccattgatatctctgtgactcattctccagacaaaaattgtgctgaattataagtttctgtttagtgaactgtgcttaatccagattcacatgcagagaatcaagatccatggtgggcaggaaattatcagggagccattcctcattccagtaaaaccaaccataaatttggataatataaatttagcctgccttgttccagaaagactgctgcaactcactgattcaatccaacatggtaattttggtttgatcc

SEQ ID NO: 320 - DNA, 801 bp, Homo sapiens
  misc_feature (401)..(401): N = A/C/G/T
cagtgagtgtcaggaaggaagggctcagtgaggaggtcacaccaggacagaggggagtggggaggagctgcagagctaaaccggtacctgatcctccagaaaacagccaagactcacagtgcttgcaggtttatctgttgtaaataacaatccatgagcatccccactgcagtaccgcagagatgtgggatgacagaagtgcacagggagggaatggccagtgccatggccctgaggctgtactgtagctggtgtgcacagaggggcagagttgttggaagtgaggcatagtgagtaagtatgaaacaagatccagatagccttctttgaggcatgggggaaagccaagaggagtggacaggcctcttttctgcccctcagatgccagagcggctggcaanggagatttgtgccctggacagcagcaaggagcagctgctcaaggaaggtgagaccagggaaggtggatggcccatatctgacctcacgtgccttcatgtgctcacctgcccctttgtgctgcagagaagctggtcaaggcgacactggaagacgtgaagcatcagctgtgctccctgtgtggggctgagggcccctccacccttgatgagggactctttctccgcagccaggaggctgcagccacagtgtaagatgtggaggggaagagggtgggaggagggagtggccggtgctgaccaccccctactgggccccccaggcagctgtttcaggaagagcacaggaaggctgaggagctcctagcagctgctgcccagcgccaccagcagctgcagcaga

SEQ ID NO: 321 - DNA, 601 bp, Homo sapiens
  misc_feature (301)..(301): D = A/G/T
cccactgagcttgtgaagtgccggctacagaccatgtatgaaatggagatgtcagggaagatagcaaaaagccataatacaatttggtctgtcgtgaagggtatccttaaaaaggatggccccttgggcttctaccatggactctcgagtactctacttcaagaagtaccgggttatttctttttctttggtggctatgaactgagccgatcgttttttgcgtcagggagatcaaaagatgaactaggccctgtccatttgatgttaagtggtggagttgctggaatttgcctgtggcttdtcgtgttcccagtggattgtattaaatccagaattcaagttctttccatgtatgggaaacaggcaggatttattggtaccctcttaagtgttgtgagaaatgaaggaatagtagccttatattctggactgaaagctactatgattcgagcaatccctgccaatggggcactgtttgtggcctacgaatacagcaggaagatgatgatgaaacagttggaagcatactgaagtgtcttggtgaacctggatccgagtccatgagtttgaggactacagttcatcacagggttcagcagag

SEQ ID NO: 322 - DNA, 801 bp, Homo sapiens
  misc_feature (401)..(401): Y = C/T
gcctcactcttcttttcttggacctcttgttcctttggcacatctgcctcagtcttctctacttggccttcttgtccttttggtaccttcaactcactcttctctacctgggcttcctgtcctttcagtacaactgactccctcttctttacctgggcttcctgtccctttgagacaccagactgactcttctttacttgggattcctgtcttcttggcacacccatctcactcttctctacctgggcttcctgtcctttcagtacaaccaacccactcttcgttacttgggcttcttgtccttttgggacacctgactcactcttctttacttgggactcctgtcctcttggtacatctgacacacttttctttatttgggctccctgtccttgtggtayactcatctcactgatttttagttgggtttcctgtctttttggtattccagcgtcactgtctaccttgacctccattcctattttgtctttctctaaatcagtgccttttccttctctttctggctcctttatgtgtgctgatttcaaggattctacagaattcgtaaatatgatgtcattctttagtgcttccttgttttcttctcggctattctgagaccttgcagtgcctccacattttagaatctggattttggaacaagatttttttgcaagttcttcatccatgtaacctgttaatataactgagcatacaacaaaagggcgtgatttagatatcaagtattttctctttatttctatttttttccccttgatactggttccttttttgtcttaa

SEQ ID NO: 323 - DNA, 601 bp, Homo sapiens
  misc_feature (301)..(301): M = A/C
gacaggatttcgccttgttagccaggcgggtctccaactcccgayctcaggtgatctgcctgcctcggcctcccaaagcgctgggattacagacgtgagccacggtgcctggcttcagtaaggactcttgaagccactgtactgcccttcactcttyggaaactctttcyggatcctccagcggcagcagctgggcaggwtggcaaagtcagccatgtcctgggagccraagcgccaggtggcgtagcacctgtaggcacagtgccgcagcyggctgttggtggaatccacatccagcgcmagcaagggctcctggtagagcaggaggaactgcaggaystgtctggacaggaccagcttcctgaacagctctgaggtggtgatgcaggcccccggctttttccggcagcacagckcctccaggcacctgtggctctcagggagttgagatgggaggcagcttccacactggcaccagacrgggctatccctggatctaggagtcgcctcctttctaagcagcygtatctcctctggttgtccaggaatcgggggtgtgtcatggagggccaggggcagcctggacaaatctgtgaagtcc

SEQ ID NO: 324 - DNA, 601 bp, Homo sapiens
  misc_feature (301)..(301): K = G/T
cagtaaggactcttgaagccactgtactgcccttcactctttggaaactctttccggatcctccagcggcagcagctgggcaggatggcaaagtcagccatgtcctgggagccgaagcgccaggtggcgtagcacctgtaggcacagtgccgcagccggctgttggtggaatccacatccagcgccagcaagggctcctggtagagcaggaggaactgcaggacgtgtctggacaggaccagcttcctgaacagctctgaggtggtgatgcaggcccccggctttttccggcagcacagckcctccaggcacctgtggctctcagggagttgagatgggaggcagcttccacactggcaccagacggggctatccctggatctaggagtcgcctcctttctaagcagctgtatctcctctggttgtccaggaatcgggggtgtgtcatggagggccaggggcagcctggacaaatctgtgaagtccatcgcaggtctctgaaaaagcaagtttccaaacctattagccatgacaagccctcaggttctaggttctttaattttattaacttataaagttacatttaatattacatgactta

SEQ ID NO: 325 - DNA, 501 bp, Homo sapiens
  misc_feature (251)..(251): R = A/G
aaaggaagtagcatgcaggtgcctgatcagggcctcattatgcagtagctccacacaagacctatgtatgatcaaagacatattgttcataattgccattcttctagaaaatttcatcagaagatgttctgtttcaaagaacgattgagtgtgacccagcaaaaggcgatcaaattcgtcctgggtccatgaaatggcatacgttgtcagggtgaaaaagttctcttctttgatgtacatattcacctccrgggtgaggaccaccacctggtggcctctcgcatggaggtcccgcaaggcctcccgcatgctgagccagtggctgccatcagtgggcaccaccagcaccttcccactctcagcccagggctggacactgaggagaagcagcagtcctgtggccagctgcggcaggggaacctggagtcctgtggccatctcagcagaagccaccgacagctgactgtccaccccacgttgtgcctcctagaattgtttcct

SEQ ID NO: 326 - DNA, 801 bp, Homo sapiens
  misc_feature (401)..(401): S = C/G
aaggagaatggtacatagtaaaaaaattctgaatacctcatggaattgagcatttgaataatagaatattctagttacttttgatttattctagagttatattttccaatgacttagggcctcattaattatattaggcttttgtggaataaagcctttttataaacttcacgtataaatacaggagatggaggaaattggatcttttttggtgtattttgtttttatttaaatagatttattgagtttttctaacattattaaaagcaggatagtgactgcttagaaattctttatcatctcagattattatgtaaaaagtagccatgttaaggaaaaatggtctctgaaaagccgtatctttcaaaaacacaatgtttttctcctttattttttaaggsaaacagtttcgaatctaaagattatctccaggtttgtcttcgaataagaccatttacacagtcagaaaaagaacttgagtctgaggtttgtgttgaatttaatagaattttaatattttactttcatttaaaatggcaaaatactagtttttatttattgggggtatgttttctagggctgtgtgcatattctggattcacagactgttgtgctgaaagagcctcaatgcatccttggtcggttaagtgaaaaaagctcagggcagatggcacagaaattcagtttttccaaggtaaaactgaagtgtttttgttttttgttttaaagataaagagacttggcttaggctaaattgctatataattgtatataatgaactatacattttatgcttatgca

SEQ ID NO: 327 - DNA, 601 bp, Homo sapiens
  misc_feature (301)..(301): W = A/T
tgtgtgtgtgtgtgtgtgtgtgtgtgtatgtaatttttttaaaggcaaaaataagatcatgctgtgcatagtgtgttgccactgattagctttatttaactttaaaatttgaaggaattataaaactgtttgcattattaatcatatttgcattctagttatcctaaagtatattcatgaaacattgctttttcttctttccaaagaaaataattacacagaatcaaagaattaaagaattgataaatataattgatcaaaaagaagatactatcaacgaatttcagaacctaaagtctcwtatggaaaacacatttaaatgcaatgtaagaatttaaccttgtgttatattaataaattagataagcatatgttttggttgaaaggaaataatttaaaatagcttatgcaactaagactaatttattgagaatgttgaattgcttatgcaacattgaactcaatttactgttttccaaatctgaatttttgagaacttagacgagggtgtttgacttctttgaacatacttttccacaagatacgctggcagtgctttgcatgtaaaaaggaggagaatatgtagcctttggacgtttaa

SEQ ID NO: 328 - DNA, 201 bp, Homo sapiens
  misc_feature (101)..(101): R = A/G
gagctcttcaaagctctcaaatgtagaagcaagtaaagaaaatgtgtctcaaccaaaacgagccaaacggaaattatacacaagtgaaatttcatctcctrttgatatatcaggccaagtggtaagctagtatttctgttttcatcaatgtagaactgttcgtgttctttttaattttttacagtggtttgaatttcaatt

SEQ ID NO: 329 - DNA, 801 bp, Homo sapiens
  misc_feature (401)..(401): R = A/G
ttggaaattttagtccatttacattcagtgttattattaagtaaggacttacttctgcctttttgttatttgtttactggttgttttgtgggcttctcttccttctttcatttcttcctgccttcctttattgataataattttctctgcatatatgtgtacagatttttcttaatgcctagcttaaggcacagttacacatttgtgcatctgtagcagtcctctctttaagttacacatacttccagcactataatttaaatttattatgatgtttggataccttcatcatgattcatgtacccctgaattgctagaacaaatgttccatttctctccttttccatcagttcttacttgtgtcttgtcagctaaagtccaggaagagattgaacgtgtcrttggcagaaaccggagcccctgcatgcaggacaggggccacatgccctacacagatgctgtggtgcacgaggtccagagatacatcgacctcatccccaccagcctgccccatgcagtgacctgtgacgttaaattcagaaactacctcattcccaaggtaagtttgtttctcctacactgcaactccatgttcttttattcctcaaattcacagtatgattcttaccctctaccatcactgggtgagagaagtgcattactcctatgtatggcagtttaattggactttctgttgattccagtttgggactataaagatttgtaacaggtcttagtgtctcacagtgtgtgtttttcagatttattctttcttcaagattgttctggctactcttaagt

SEQ ID NO: 330 - DNA, 863 bp, Homo sapiens; identical to SEQ ID NO: 173
  misc_feature (258)..(258): W = A/T

SEQ ID NO: 331 - DNA, 863 bp, Homo sapiens; identical to SEQ ID NO: 173
  misc_feature (319)..(319): K = G/T

SEQ ID NO: 332 - DNA, 601 bp, Homo sapiens
  misc_feature (301)..(301): R = A/G
ctaaagcagaaaatagttttcactcatcatatcactattcagagacaaccaatattgatattttaatctcttatttctgtatatgtattaatacttacacagttgagatcatattgtatatacaaacttccctttgccaattgttttgattttaatgatttttttttgttattctttgcctgctttttttttttaaaagataatagaaatttaacattgttttgcaatgaatttggataccagaatgacatcgacgtggagaaacctttaaattctattcaatatcaaagaagacaagccrtgggtatcccattcatcatacaatgtggtgagtgttgaagtccattataattaccaaatgttaagggttcttaaatatgcaagtcattgtgttaagaaatgagggatgagggagacaaaggtaagacatcttgctttccaggagtttacagtctagaagaaagttataagtgtgaaaataattgtaatacagggaaaaataaggtaagtgatatactagagacaaataattatttgagggttcaaagaaaaggatgggggagtagaggcaagattctatgatggagtagcatttgtgata

SEQ ID NO: 333 - DNA, 801 bp, Homo sapiens
  misc_feature (401)..(401): W = A/T
actgtctggccctgaatttgcatggcttgagaaggcacaccgtaagactaagtaggaaaaatccaagtaaggagtgtttctgagactttgatcacctgaactttctctagcaagtgtaagcagaatggagtgtggttccaagagatccatcaagacaatgggaatggcctgtgccataaaatgtgcttctcttcttcgggatgttgtttgctgtctgatctttgtagactgttcctgtttgctgggagcttctctgctgcttaaattgttcgtcctcccccactccctcctatcgttggtttgtctagaacactcagctgcttctttggtcatccttgttttctaactttatgaactccctctgtgtcactgtatgtgaaaggaaatgcaccaacaaccgwaaactgaacgtgttcttttgtgctcttttataacttgcattacatgttgtaagcatggtccgttctatacctttttctggtcataatgaacactcattttgttagcgagggtggtaaagtgaacaaaaaggggaagtatcaaactactgccatttcagtgagaaaatcctaggtgctactttataataagacatttgttaggccattcttgcattgatataaagaaatacctgagactgggtgatttatatgaaaagaggtttaattggctcacagttctgcaggctgtatgggaagcatggcggcatctgcttctggggacacctcaggagctttactcatggcagaaggcaaagcaaaggcaggcacttcacacagtaaaagcaggagcgagagagag

SEQ ID NO: 334 - DNA, 801 bp, Homo sapiens
  misc_feature (401)..(401): R = A/G
agccgtgctaagttgttatgctgcaaatcgagaatttctagtttctcaagaccctccaacatgtcatcatttatgttggctatgttgttgttgcttagatccagaatggtcaagttacgaagaggctggaatggtgaaggagagctatccacatttttaagggccacccttcggagcatcagtcgttgaaggcttgggaccaaggcaaaggagttcctagtcagctgcaggtacttgttgtaggaaagatagatttcgaaaatattttctagacctctccattcctggcctgtgagttcttgcccaatttcattaaggcccaggtcaagtacttctaggtggcccaaccaagagaaagcatcactctctatttttgagattttattcttggttaggttgartatgtgtaagggagaatgagcaagtgatacaaatgtttcatttgtcaaagttcgcaaacttgtaaaggagttggatagacttaagtatttcaggtttatcaatcctgtgaacatattgctttttatgcctggaatatcattatcttccatgttaaggtgctccaaacattttagccactgaaaagaaaaatcatcaatcttggggagtgaggcaagggaaatactttgtttagtaaaagaccgtttcaaattcaggtacctcacattgaaaagcccgtgcaaagagtgagaaaacaaatgctgtatattattatactctaggaagaaatattctagttgtggaagccaagcaaaggaatcgttaccaaccacatttaagttgttgtaggaaagatcgagc

SEQ ID NO: 335 - DNA, 601 bp, Homo sapiens
  misc_feature (301)..(301): Y = C/T
aagagcattttcctgataggcctccaccatctgtagcctcaacatccacgtcataagactgaatttcctcaaaatccaaagcctttctcagccgaatttctcctgtgattgcgtttatttcgaagggttggttgacgtcatcgacttgaaacagggcgtaagataccttcccaaacgatcctgcatctaaatctctggctgagacggtaataaccagagagccgagggggttgttctcagggacttgtgcttcatagagctcctgagcaaactcggggacgttgtcattgatgtccaaaayctggatctgaatctcggaggtccctgaccggggcggagacccgccatccagcgcgatcagcgttagcctgagttggggctgctcctcgcggtccaacggtttgtctagcaccagctccgggaacttcctgccttcgctgcgattgcgggtgagaacgtggaagtgagggttggagctgattgtgtacctctgaaggccgttgctgccggtgtctaaatcgtgtgccattttcaaaggaaatatctttcctggcatagtaatttctgatattttcaggagcatttctctggcagggaattc

SEQ ID NO: 336 - DNA, 704 bp, Homo sapiens
  misc_feature (201)..(201): Y = C/T
gcatggaaggagccatagcaaatgagaaatagccattcattcaagaggaatgtgactatattttagacatgcctgttgagagaaatacttacaattttgctttacacatggtacactgattgttgtacgatttgccatcagcatcacgtacaggatcactctcccgagtacagctgagtcttccatttttcatttgttccygatactcagcacattcgtcctgaaaacagagaagaacgaagagcccctggattacttagtctactgtattcttagtaaattgttttaacagtctgagtaagagaagttctttcacctctctttataagaaacataacattgccgggtacggtggctcatgcctgtaatcccagcactttgggaggccaagatgggtggatcatgaggtcaggagttcaagaccagcctggacagcatggtgaaacactgtctctactaaaaatacaaaaattagctgggcatggtggcgggtgcctgtaatcccagctacttgggaggctgaggcaggagaatcgtttgaacccaggaggcagaagttgcggtgagccaagattgctccattgcactccagcctgggtgacagggtgagactccatctcaaacaaacaaacaaacaaaaaaacccctaacatctaggtctggcatctgcagagaaaaggggaccagaatcacccatgttgtaa

SEQ ID NO: 337 - DNA, 601 bp, Homo sapiens
  misc_feature (301)..(301): R = A/G
gatttcatttttcatttttaatacaagtagggctggtgaaactattatatttagggaagcaaaggaaaataaaagtattttaatttgtggtactactggcaaacactgaaggcattttaaatgagatctactgaattagtcttgtaaatagtagctgtttcattgtatatttgtcagcgttagtccagatccatattttcaatcacgttactataaaggacttaaatattattgttcttctctatattagtgaagaaatgtcatgttttctttaaggttatcgtgcttttactgaagccartgatggcagtctgtgtcttgctatggaatatggaggtgaaaagtctctaaatgacttaatagaagaacgatataaagccagccaagatccttttccagcagccataattttaaaagttgctttgaatatggcaagagggttaaaggtaactatgtcattatattttaaatgacttctgtttttgttcatattttaaatgaacaaataatcactttgcaggacatctttgaatgtggatggatattgttacttgtcagttccaaaaaggggttagcggaaaacaaaatagaggcttacatt

SEQ ID NO: 338 - DNA, 801 bp, Homo sapiens
  misc_feature (401)..(401): Y = C/T
tccagcttactggcagaggaatagaaaccacacattctcctcatcagcttactgaaggtgacattgtgtttcctcaacctaatccaaaactcagaaggatttttaacaaactctacctgcgcatcgtagaaggcattcatctttaacctgatagatcttaaggctgggagtgaaatctcttcatctacttcttcagcaggagactgagactgagatgtttctggttcctcctcctctgttgcctggctctgaaggactcggtcagccaagcaacacgactgtactccaaacacacggttcagattaatcccatcttctccatacaggctgacataatacacatgctcaaaggagcaataaaattcaatctttgcattcactgccttgcctagtatcagtgycttcaggtcaccgacctgtgaccgagaccagcctctcccaccgtcccagagtccatacaaagcacaagggtaggtcaccaccggcattcgaaaatattcaggcagcaagtaccgaaggctgctgcaactcactaactccttccttccatagtccacatgaagcacctgggcacagcgctggggccgaaaagtctcaagcaacagtgctctgtaccaatgtccatccaggccacaggatgcacacggagagcccggcttatctgggctctcctccctctcctcccaggtggcactggtagagttctcatcccctgtccccgtggaaccccggtatacctgggccatgctctcggagaggcggtggatctcctgcgagacgctgcggagctggcagtgaatg

SEQ ID NO: 339 - DNA, 801 bp, Homo sapiens
  misc_feature (401)..(401): R = A/G
gcatgcctgtaatcccagctactcaggaggctgaggcaggagaatcgcttgaacctgggaggcagaagttgcagtgagccaagatcgcaccactgtactccagcctgggtgagagtgagactctgcctcaaaaaaaaaaaaaaaaaatagtggagcaacaggtctctgagaataagatgtttcccagtgcagggaggtgggctgcagtctgtctgtcctccctgtgaggtggggctcctccctgtgtgggcagtgagagggcacctggtaacacacaggcctgagcagtgtttctcccccacagactggttcaggcagaccctgctgaagaagcccaagaagaggcccaactccccagaaagcacctccagcgatgcttcacagcctacctcacaggacarcccactacccccaagcctcagctcagtcacgtctcccagcctgccacccacacatgcgagtgacagtggcagtagtcgctggagcaaagactatgacgtctgcgtgtgccacagtgaggaagacctggtggccgcccaggacctggtctcctacttggaaggcagcactgccagcctgcgctgcttcctgcaactccgggatgcaaccccaggcggcgctatagtgtccgagctgtgccaggcactgagcagtagtcactgccgggtgctgctcatcacgccgggcttccttcaggacccctggtgcaagtaccagatgctgcaggccctgaccgaggctccaggggccgagggctgcaccatccccctgctgtcgggcctcagcagagctgcctaccca

SEQ ID NO: 340 - DNA, 801 bp, Homo sapiens
  misc_feature (401)..(401): R = A/G
aaaaaaaatagtggagcaacaggtctctgagaataagatgtttcccagtgcagggaggtgggctgcagtctgtctgtcctccctgtgaggtggggctcctccctgtgtgggcagtgagagggcacctggtaacacacaggcctgagcagtgtttctcccccacagactggttcaggcagaccctgctgaagaagcccaagaagaggcccaactccccagaaagcacctccagcgatgcttcacagcctacctcacaggacagcccactacccccaagcctcagctcagtcacgtctcccagcctgccacccacacatgcgagtgacagtggcagtagtcgctggagcaaagactatgacgtctgcgtgtgccacagtgaggaagacctggtggccgcccargacctggtctcctacttggaaggcagcactgccagcctgcgctgcttcctgcaactccgggatgcaaccccaggcggcgctatagtgtccgagctgtgccaggcactgagcagtagtcactgccgggtgctgctcatcacgccgggcttccttcaggacccctggtgcaagtaccagatgctgcaggccctgaccgaggctccaggggccgagggctgcaccatccccctgctgtcgggcctcagcagagctgcctacccacctgagctccgattcatgtactacgtcgatggcaggggccctgatggtggctttcgtcaagtcaaagaagctgtcatgcgttgtaagctactacaggagggagaaggggaacgggattcagctacagtatctgatctac

SEQ ID NO: 341 - DNA, 801 bp, Homo sapiens
  misc_feature (404)..(401): R = A/G
agagagaattgatctctggtctcataatttgagccctctgagtattttgcaacagagactgtggtggcttggataagggggagacagaggtactacacatgttgttcccatcctcctccctcccagggaaaaatgctcacatcatctatcccttttcccctagctcccttacatcaacccacaaatcctcgaagcccggccaacacacagatgtgcaaacacttccgtgcacacatgcaccttttccaacacacacatgcacaggtatagacacgtatctacacagttggctgtagcctaggggtattttaggggatcctcacctgctatcaccaggtgctcttggttttccccttggcgtccatgattcagttcttctgccagggacatttccatctccrccttggtgttgggagggcctcctgccatcacaaccagctgttctcttgtaagctatggctaaggatgcacagggtgccaggaacagaggagtcacactcagaaaatcacctcttccggaaacaggagctcaaggaagatatagtcagatctgggggtggagtgagactccctctctaggctgaggccttggacacagtactttctgtttctattgtatcttgctggctaggtcagtggccttctcctctgctactctgtaagcaacttaggagaagagatacaattccgtgcctttgcctgtgagaactgctctggctcatgaatctccatatttagcccatggggagaagggtggggtccaccctccatcatttctatgaagaaacagggattggcaca

SEQ ID NO: 342 - DNA, 812 bp, Homo sapiens
  misc_feature (315)..(315): N = A/C/G/T
gaaaatcgtgactggttagttcattcagcagatttttattgagcgcatactgtctgccaagtgctattcactccagagacagccactcatcccaagccctgccctcacagagctccccatctagggaaggggagtcctgaggctcccctggatgtgaccaaggcttactctcaacacttagcttctactccatgatgttcttaccaagcaggcagtcttggtttcctctttcgtgtggctgccgcattctgtcttctggagtttgtataggggacacatgtcaagatctttcacgaagattttcctcaggacacncatcgtcatgtgatttcctgtctggaccatgcaacagagagcccagggattattaacgagaaggcagtcccctatgtcaacacaactcccactcatatagccaaacgagagtgagaatttttttttttttttgagttggagtcttgttctgtcacgcaggctggagtacagtggtgtgatcttggctcactgcaacttctgcctttcgggttcaagcaattctcctgcctcagcttccggagtagctgggattataggcatgcaccacaacgcccagctaattttggtatttttaatagagatggagtttcaccatgttggtcaggctggtctcgaactcctgacctcaagtgatccacctgccttggcttccctaagtgctgggattacaggcatgagccgctgtgccctgccaggaatgttcttataaatccctttttttcatagaaataagaacctgtgactgagtttttactgaaaactacctccactttgaa

SEQ ID NO: 343 - DNA, 601 bp, Homo sapiens
  misc_feature (301)..(301): S = C/G
tttacaatgcgtcttgtgccacgtgctatcctccgtccaacccttactggactatgcaagccttactgggtgacccagtgttttacttgacttgcctgatgacgcctgtcgctgcactgctgcccaggtgggtgtcggagcgggatagtgcctctgagccccgagtgagcccagacgacattggcattgcttctgctctgtgtgggtctctggaagctcaaagacaccaccgacaggaatatctaactttttgttttaatgtactttttctagattgtttttcagatccctccaggggagsgttttccccacacaacttcagctggcacgtcagttgaccaggaagtcccccaggagatgcagtgctcccaaagagacctttgctcagggacgcctcccgaaggactcgggaaccgagcactcatcagggaggacagtcaagacctctgtgcccctgtcccagccttcttggcacacacagcagccggtctgctccctggaggccagcggggagcccagcacagtggacatgagcatgccagtgagggagcacaccctgctggaggggctgagcgcaccggcccccatgtcctctgcgcca

SEQ ID NO: 344 - DNA, 601 bp, Homo sapiens
  misc_feature (301)..(301): N = A/C/G/T
gaaataatcttgccatgtgattatcttttcgaaaattaaaaattattgtaaaataattccatggtgaaaactaatcaaaattttaaataaaggcagactgcacccagcactctcatgcctcagtgacctcaggagaagttcccttccgtccttgttctttctgtccgggaagcgggactggggtacccaagtctggggccctacaggcagtgggaggagaagaggcccagttcttggagggtaaaccccaaaacaactccaatccatcctcaggcaaaatgaggcctatatcaggagtgangctaggggcattcgggggagctggagccacagccctggtcttcctgtacttctgcatcatcttcgttgtgtgagcattgaccctggggaggaagagccttgggggagggcaggctgggaacaaaatccctgaagccagacctggaaggacctggatgggtcaagagcttgaagcaagggccagaatgaggtcatgggtgcatggtaagaatttcatgagcgcccctgtttgtggagctccatgtctgtggcaaacctcagaccctactgcccaggaaaaaagagcctctgttttcgacat

SEQ ID NO: 345 - DNA, 707 bp, Homo sapiens
  misc_feature (495)..(495): S = C/G
gtagatggatgatcggacagcgatgaacaaataaggacaaatagacaactggatggacaagtggatggctggatgggaattacggaagtcaggagaggatatctggagcctactagaacctggacactcatgagtggttttccttcaagggctggcaaatttcttctgtaacacgccacacagtaaatatgtgagcttttggggagcatgttcagtctctatcacatattctttgtgtttaaaaatataatcctttataaatgtaaaactacccttagctcacagaccatacaaaatacgccacaggccaaagtggcctgtgggccacagtttgtcagcccctgttgtactttgatggaacctgtctgtgtgcctctaccgtatcctgtgattacaaaggagccgtgggaaggacaaatcaaggtgggccccactctacgcagagcaggacactcttactattccacagctgaagatgtccactcgctttgtcasctgccccacccggatgaaatcctctggcagatacgcggctgacgtccggagcaggtgagtcttcatcatggtgtattttgaccttttgttgacaggacacagatgagccattgggtgagcaagtttgggggtgagattttggtccagcaagacattagagctgtggaaatgaaaggagagggaaccttctcattttgagctggataacaaca

SEQ ID NO: 346 - DNA, 848 bp, Homo sapiens
  misc_feature (402)..(402): S = C/G
ctgaacacatccacagccatgaagatggtgcttttacaaacgaacagtctcggtgagtcacaccactcttgcccatcctttgacagatcctcgtccctgcctctccttcctctcagtggccattgaaaccctgaactgcactaccattgaccctttaaaagtttatctcactgaagactattacaacaatgagaagcagaaatgaaatctttggaaagataagtagatatggaagcacttgtaagtaaatacattttttaaaaagtgttttgcctggaacattgattggataaaggcaccaatacagacctgagatagtggcttcccgttggcacagttgatgcccccaatgaagaccatgttgggcatgatcggcctggggtagtccatcacaaagtcccstcggaacagccacacagatgcatggctgacaagatccaccactgacacctctctctgaaaaagctcagaggcaaggcttgcataaggagcagaaacagcatggcaaaggtaggacagggccagagggtagagcatgttcttgaccctttgcaggaatgtcatgtggtctgaattggtcgttagtaatctaggaatataggaggaagggtttggacactgtgtgcccttaaagtctaatcacatggaatgttcctcaagaaaacacagcaggaatcgacaggtacttagccagcaccgcgcgcagaggtgaaaggggtctgttagaaccacatcaaaggagtagcatgcaggtgcctgatcagggcctcattttgcagtagcttcacacagacctatgtttgatcaaagacatattgttcataattgccatccttctagaaatttca

SEQ ID NO: 347 - DNA, 511 bp, Homo sapiens
  misc_feature (256)..(256): M = A/C
gtgagcaacagaacaagagactgtctcttaaaattaattaattaaaaacatgggaaactcctttaattttaagtaagacaagaaaaaggcattaggagccatacggttgtgaaaagccttgtgtggctttggttcaggagagaatgatgataaatagaattttacttactatattgtgcttcctgtttttcagacattgttgaggtcattaatgaaaacgtaaagaaaagcagaagactgattatcattttagtcmgagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtcc

SEQ ID NO: 348 - DNA, 501 bp, Homo sapiens
  misc_feature (251)..(251): R = A/G
tgggttgaattctttttatcactcccacaaataacaagtaggtgctcaaagtaacatagcccataagtcatatgctattaaaaaaaaaaaaagtcagttacctaaatcacctgtaaccctgtaagatccatttgcaaaaatccagaagaaaattcctctggcacttctaatcaaaataccacctttatttactcttcctgcaatgaacacacctcctgtgtcaggggtctctatgtatacatcacactttrtagtcagattggtcctgcaaaataaaacggttgattagtactctttaaaatatgccctttgtaacatagtacagatatgtcatttcacagcacatgcttccaaacttctaattgaggtgagaatgtgatttgctaagtctaagcctgtagcagagatgggcttcaagaatctttattgacaacagttttaaatgttacatgacttaagtcatttcattgcctctttaaatgattactggacaataatagt

SEQ ID NO: 349 - DNA, 801 bp, Homo sapiens
  misc_feature (401)..(401): R = A/G
gtgggaagttgggaaaaattctcaagaacaaagaatcatactgatcctaatataatattttgtaaatttaaatttaatattaattattcattatttgtgaaaatagctatctaataacaacttctgagagcatggctgccaggaggtattatgtatataatgaaaagcatatgtatatatgtaaaattaaaatatctcaggagaaacttactataactatacctaccttgcagattaagaaatcttttgaaaaaacttaaataatttatgcttcataggtatataattttcaaaaggaaattgcatctttatagttattgtaataaaaatatcatatcattctagctttaaaaaatgtaacccatcatcagatgaaacatgaggacagctactcatctttrggagtcttagagtgtcactattattggccacaagaatcttcaatgaaggatcatccactggtgtatcttcaattttgattgatgataatgattttgagttgataaaaacaactgtaagtgctgacacaaaatgagacttgcatggcaataagaaaaaattatgaaaacattattttaaaatgtacagctttaagtaattcattaaaactatatcaatacatgctaatgataacatagtaagaaccatgaacatacggctgtttccacagaatcattttctagtagaagatatttttataatgaagtatagttttatactttttataattgataaatgaaatagtgagaaaaaaaagcttcaaagatttcataaaacatgtcttccaattacttcaattaa

SEQ ID NO: 350 - DNA, 1202 bp, Homo sapiens
  misc_feature (102)..(102): N = A/C/G/T
cccccccccccccccccccgatttggctccagccttagccctcgtcccctccccaaccccctgcaggctgggactgctccgaagatgtggatgagtgtgagncccagggtccccctcactgcagaaacgggggcacctgccagaactctgctggtagctttcactgcgtgtgtgtgagtggctgggggggcacaagctgtgaggagaacctggatgactgtattgctgccacctgtgccccgggatccacctgcattgaccgggtgggctctttctcctgcctctgcccacctggacgcacaggtatgggggtagagggtatcaggaggtgggaggtagagaaggagggtgagagaagcaccaggaggactgctaggagcttcaagtggcctttgagagcctcaccccctcttacccctccaggactcctgtgccacttggaagacatgtgtctgagccagccgtgccatggggatgcccaatgcagcaccaaccccctcacaggctccacactctgcctgtgtcagcctggctattcggggcccacctgccaccaggacctggacgagtgtctgatgggtgaggccactcccacttcagagcctctctgagcctcagacaggcctctgcactgaagacagaaaagggggcagattgcttttccaattaaaaaaccaaacatctttttccttgaatttgcccagatttggcatctcttgcctacatgaccctctctccaatgttcagcccctcagtccccatgagtttggtcccttatttcctttccatcttaaagacacaagccccttccccaatttggtctcgtctgccacacgcaggcccccacaccttccctgacagtctcacctccttgcccttcctgccctgacccctgtggactcccagctcttctctcctcccagcccagcaaggcccaagtccctgtgaacatggcggttcctgcctcaacactcctggctccttcaactgcctctgtccacctggctacacaggctcccgttgtgaggctgatcacaatgagtgcctctcccagccctgccacccaggaagcacctgtctggacctacttgccaccttccactgcctctgcccgccaggtatcagctggatggggccttgggtggggaaaacagggaactagtcctgaacccactaggaatgccccctccagagtaagaccc

SEQ ID NO: 351 - DNA, 801 bp, Homo sapiens
  misc_feature (401)..(401): R = A/G
ggcgtgatctcggctcagtgcaacctctgcctcctgggttcaaacgattctcctgccagccttccaagtagctaagattacaggcatgcaccaccatgcctggctaattttttgtatttttagtagaaacagggtttcaccatgttgcccaggctgggtcttcaattcttaataaggttttaagataagatagtaaaatgagagcacatgttattacaaagtagattaatttaaataattaaaatatatattctattttctttcactatgatttgaagctcttaaagttttaacactcattttaaagctagatattaaagaagaaattgaagatgaagaaaagacaattgaagattatattgataaaaagatgaatgatgctgattccacttcagttgaarctatgtactctgttgctagtcaatgtctgcatgaaaagaaaaataagagaccagacattaagaaggtatgcattttttatacttatttaaaaagtgaaaggggtggggttcatcatattttccagagtgtatattttaaagcaactgtataatgtggttcttttgtttttttctttctttttaaaaggttcaacagctgctgcaagagatgacagcttcttaaaactttattggaaaagactcttgactttttatatacacctatctcaaccatttttttaactgatttttttcctaaatattcttctttacctttaacaaggcataggctgttgcaggacagtggttattaaagcatgggttgaacttccaaaatataaaaatagagccaccatatcaa

SEQ ID NO: 352 - DNA, 801 bp, Homo sapiens
  misc_feature (401)..(401): R = A/G
ctttcatacgttccttgactctaacattgcttgtgttatatagaagttttaatttttatgtactcaaattatctattctaatggctcttgggttttgtatcttacttataaaattcttttcatttcaaaattaccaagaaattttacatttttctttcttatttatttattcatcaataagctctaaaattgatttatttggagaaaatatttatgctcttctctagatctgaaatatttggtttgctgtcacttttagattgctccttggtagaattagctttcctagcttgtagctgagaggaggttaatctctatttttcttttggtcctagtggaaggaggcatgcatccccagctgataccttcggttattgctgtagttttcatcttacttctcrgtgtctgttttattgcaagttgtttgggtaagttattagccaaagtagaactcttcttgaattattatttccaaacaacttttctgaagttgctctaagccttttggtatcttgatttttcctagcataacctatctataatatcttcagggtcttgcactgaatattcagagctacattcttgaccttctgtctttcaatggtggtaccttgtgatagagattgattgatggaatttagaccattttctgtacatgtaaaagttggttactatagcaaatttccccccattttggactgggatcacaaagggatacatcttatgagaaaagagtaagcagaagaaaaataactttcagatagactggctttgaaaagaacaaggttggaagaattgttc

SEQ ID NO: 353 - DNA, 801 bp, Homo sapiens
  misc_feature (401)..(401): K = G/T
caacaggggaggtggcgtccacagggatggcccactgctcctgagatggaggctctggggcctctggggtggatacagctgtggacgcttcctggaagagtcaggggtagcagtgataaagatacaaccagagggctctcaattagcactcctcccaaaagatgtccctttcttcccctcagacccatcctagccagcccacatcctggtggcaaggctctttcttgcctccactacacagaaccaccaaccttcaacactaggtcttccaagctgcttgctcgggccaggggagcactgcagggagaggctgaaacagtgtcccctctgggacctcctggctgtcccactgcctcattctcatcctcgtcacccccacccaaatccagaggctccaacakacagctaaggcttagtagtccaggagctggagttggacaatctgaggagcaagccaacaaggtcaaccttgtcatgtccatctctgttccttaggagaaggacatgacttctcctacaccccactcaaaaactaaaactaaccttttggtgcaaagtccatgcctttcttgaaaccaggtggaatagtaagaagatctgtaggatagggacatgaaatcaggtcactgcacactggtgaacaaattgtgtacattatataaacctaaaagataccatttacaggacagatgctgtagatagggatgtttgctatgacactttcccaacagatgacagtaaaggttgttgtagaaatttcccagcagatgacagtaaaggttgttatggacagaatatctt

SEQ ID NO: 354 - DNA, 601 bp, Homo sapiens
  misc_feature (301)..(301): Y = C/T
cgggttcgttcaagccgccctgcagctcttcgaagctgtcgatgacgaacaagagtctctccggttgagacacgatctctgttataggagcagcggggtcaggccactctctggaaatcaagtcagccaaactcgttggcggcaactccctcagttctctgcagcagaaatagaacgtgtacaggaacctatcccgaaagatcttgttgtccgaccaggccatcatcagcttcatcaggagtgtcgtttttccaattccttgtggtccttgaatgatcactgtacgtggctgtttcccagyttccttgggagcaaaaaggcggtccaaatggtcacattcttcttgcttgacttcctcctcaaagtataggtgaatctcagtgacagacttgctggaccataagcggctgaatttctgctttgcgtgagcttgataggtctttgtgtatcctgagtcagtgagggcaagaggagagaaaacccacaaagttaagcattcctgcatatattctttttttcttctcaggatgtatctttccagaggtctacacactgtggcccccaggccaaacctggtcagtctcctcttgtaaataaagtt

SEQ ID NO: 355 - DNA, 1001 bp, Homo sapiens
  misc_feature (501)..(501): R = A/G
ttcagaaagctttccaaatcctggtgcctggcgtattccaatagtcttcttcccagtcttcctggttacatttctccctgaacccatcctccccatccctaaaatttcccccaaatgtgaactcagtcataccagtttgctccttatgtttcattggcccttgctgctaagagcatccgcttgcaccttctgctcatccccagacaagctttgtcctgtgaccataatgaactcttcatgccgtttccaactttagcccatgttattcttcttgtctgaatatccacccttttctctgttctcaataataagttcaggcttttcgtcttctgagaagccctttctgacttccacaggctgaaccactggcttctgctcctctacataatacttcaattccagcattgatctcactctatcatgatcatgggtttagctgtctgtccctgccactgctgtgtgttcctcttgagggcaggaacatttgtttttcactttttraaaaacctctgttgcccagtctggcattaggaagtgcccattaggttgttattgcttgttggcgcttgagctggggcttgaaggtttctataatgtgtagcagtgtatagaaaacaggcaggtcagaaaaggcttctgtgcatcacaccaacatggcacatgtatacatatgtaacaaatctgcatgttgtgcacatgtaccctaaaacttaaagtataataataataaaattttaaaaaaaaaaagaagaggcttcctggaggagatgacagctgagctaagtcctggaggatgagaaggagtataaaataagataataggagaaaaaaggcagtaggaacagcatgggtaaaggtgatgaggcctgaaagaggcacgtggaaggaaagacaaatgcaggaagggggaatgggagggaatgctggggtacaggccaaagagggaggcatttggtgagtattctgcagagtctcctctgctgtgctgaggtgtggacaat

SEQ ID NO: 356 - DNA, 864 bp, Homo sapiens
  misc_feature (501)..(501): R = A/G
tggagtgagctgagattgccttattgcactccaccctggccgagaagagtgaaactccatctcaaaaacaaaaacaaacaaaacacactatcaacaagtcacagctgaacctgtctgtgcagcactcagcaatccctgccctccctccctcctccacttacagccagtcacctcaatttgatggctttttattcacattcatgtttgtatacatttaccatttacttattatctataaaaatatatatacttgtttttcatgttttaaaatgttacatgaatggcctctgtcgttaactttctgcatgcaattttttttcactcagccctgatgtgtatgagggaacaaatgcctgaggatctttcccaggtaactgagctgaaaagcaattgggcttgatgagaccctttccagccccttcccatctactcaccctgattcctgtggttacggtcattatcaaaatcattcccctggaggtctgtggcccctgtattacrcatgaaaggtgggagggtagccttgaaacctagaaagaagcaaaatgtttattcctaagagacaagctttgacctgccacggtggttcatatctgtagtaccagcgctttgggaggctgaggctggagtattgcttgaggccaggagttcaaggctgcagtgagctatgattgcactactgcactctagcctaggtgacagactgagactctgactcaaaaaaaaagaaaaaaaaagaaagagagatacaagccgagagaaggaaggtagggacggtgtggaggtgccgggatgccacagagacacttggactcatcagaacagaagcctaagggagagaaacgtgcaggatccaggtatgag

SEQ ID NO: 357 - DNA, 501 bp, Homo sapiens
  misc_feature (251)..(251): M = A/C
acggctagaaggcctggtgtggcagccactgtgcagcctggccaaagccctgcttggccctcagaacctgatcaagaagcgtctggacaagctactggactttgagcgggtggaagagaagctgctggaggtgggcagtgtgacctaccaggaggaggccgcccggcacacataccaggcactcaactcgctgctagtggctgagctcccacagtttaaccagctggtcatgcagtggctgggccagatcmtgtgcacattcgtgaccctccagagggaccttgcaaagcaagtgctgcagagggcagagggaagcatggcccaggtaaggcctctgagacttggacacctgtggggagtagccaggcaaggccctgcagccccatcagccagctgtgtgtaggggctaggatggagggaggatgggcctgaaaacaggtcatcaggcccttaggaagaggcagtgggaaccttccagatctctctcatgcccagtctccc

SEQ ID NO: 358 - DNA, 801 bp, Homo sapiens
  misc_feature (401)..(401): Y = C/T
ggacccctcctcctcttttcccagaccaagctctcaggggacaactcagaagcacaaaagtcaccactgggagcaaaggggaccaaagagccataaacagacatgtttgggatttcaaaagtttatctcaatctcctcattcccagacttccaggtgggaggcaggccgggcagtaatgtgagcatctcaaggacaccacagtcactgcgaccaagccagtctgtgtcctcatttacacaatgaaggcgatggaccacatagtctctgacgtcccactgcaccctgacagctgacaaatctgtttgtcctcaaagacaggtctgagagggaggaaaactgatggggatgatgagttagagctccgggctccctggggctggaggctcatccatcagctgcyggaggtgagaggctgccttgtccagttttgacaattccagctggagggaagaaagctggacgaggagaaaaggaggtgaggatccaggaatgaggcccctcctggcccacattccctcaggggtggagccttctgggggcctccctcagccttaccttttgttgcctctgagtccctgcctccccttctgatggggtcctggctgtgaggctgtcaagctgcttctgcaacttgtaccttcgggcggctaacagaggtagctggatctgcgggtccaccaggccctggggaagaacagggagaaaaggctcagacatccgcctgctgccaggcctccatcctccattagaaggtcccttcccctactttatagagcccagcccctcccttcctcccagca

SEQ ID NO: 359 - DNA, 1200 bp, Homo sapiens
  misc_feature (1000)..(1000): W = A/T
tcatctctccaacattcatgaaagtccccttaaacctaaaaatgtatagggctgtgctcgctttggcagcacatatactaaaattggaatgatacagagaagattagcatggcccctgcgcaaggaggacatgcaaattcgtgaagcgttccatatttttaaagtcaggaaacaacaggtgctggagaggatatggacaaataggaacacttttacactgttggtgggactgtaaactagttcaacccctgtggaagatagtgtggtgattccttcagggatctagaactagaaataccatttgacccagccatcccattactgggtatatacccaaaggaatataaatcatgcttctataaagacacatgcacacgtatgtttattgcagcactattcacaatagcaaagacttggaaccaacccaaatgtccaacaatgatagactggattaagaaaatgtggcacatatacaccatggaatactatgcaaccataaaaaatgatgagttcatgtcctttgtagggacatggatgaagctggaagccatcattctcagcaaactatcacaaggacaaaaaaccaaacactgcatgttcttactcataggtgggaattgaacaatgagaacacttggacacagggtggggaacatcacacacaggggcctgttgtggggtggggggaggggggagggatagcattaggagatacacctaaaataaatgacgagttaatgggtgcagcacaccaacatggcacatgtatacatatgtaacaaacctgcaccttgtgcatgtgaaccctagaactttaagtataataaaaaatatatattaaaaaaatatataggtctctgagaacatatagcatgacagaagctgatgaagctcctcttccaaaggctgtccaactataaaaccctctttttctgtaccccacttttctctcccgtactctgtcttttctgacagatattgatgagtgccaactgggggwgcacagctgtggagagaatgccagctgcacaaatacagagggaggctatacctgcatgtgtgctggacgcctgtctgaaccaggactgatttgccctggtaggttggtgggtggtctacagtgaaggggagggacttggctcggggatattctataccctaatctctatttgcattagagattctaaaaatcattcagtt

SEQ ID NO: 360 - DNA, 601 bp, Homo sapiens
  misc_feature (301)..(301): S = C/G
cagctctgacttctatgacatcgtggtcatcgccacccccctgcacctggacaacagcagcagcaacttaacctttgcaggcttccacccgcccattgatgacgtgcagggctctttccagcccaccgtcgtctccttggtccacggctacctcaactcgtcctacttcggtttcccagaccctaagcttttcccctttgccaacatccttaccacagatttccccagcttcttctgcactctggacaacatctgccctgtcaacatctctgccagcttccggcgaaagcagccccaggasgcagctgtttggcgagtccagtcccccaagcccctctttcggacccagctaaagaccctgttccgttcctattactcagtgcagacagctgagtggcaggcccatcccctctatggctcccgccccacgctcccgaggtttgcactccatgaccagctcttctacctcaatgccctggagtgggcggccagctccgtggaggtgatggccgtggctgccaagaatgtggccttgctggcttacaaccgctggtaccaggacctagacaagattgatcaaaaagatttgatgcacaaggtc

SEQ ID NO: 361 - DNA, 501 bp, Homo sapiens
  misc_feature (251)..(251): Y = C/T
tgtccactcacaaggcctgcttccctcatgacatctggccagtgacacccacaggggaggttgggggcagacacccttctcttccggtacccttgaacatggtgtcagggtgtggctagctcgacggacaccgaacagctccacagggagggtagtgcccaaggctttttgcctcccctaccatgtcccgcacttcctgaatgcagctcaaaccaggagcagctcccccaggattctggcctgcttcaccyctggagcaccaggccaggcggtgtctgtccttgagagccaggcccaggtctcacggtggcgtatggacagctcctccccataggcctggtcacaatagggaagcgggggtggctcctcccctagcctgcaggaagcccttggtagcccacttatccaccttctcctgggtgtgtggctcagcagccaagtccttgtgcactgggttgggtcccagcatgagcctggtggcctggcgggccctggcaccat

SEQ ID NO: 362 - DNA, 601 bp, Homo sapiens
  misc_feature (301)..(301): R = A/G
aagtgtaatgagtgtcacaagaccttcagtcacaggtcatctcttccatgccatcgtagacttcatagtggtgagaaaccttacaagtgtaatgaatgtgggaagacttttaatgtacagtcacacctttcacgtcatcatagacttcatactggagagaaaccttacaaatgtaaggtttgtgacaaggctttcatgtgccattcttatctggcaaaccatactagaattcatagcggagagaaaccttacaagtgtaatgagtgtggtaaggctcacaatcacttgattgattcatcartcaagccttgcatgtcatcatagacttcatactggagagaaaccttacaaatgtgaagcatgtgacaaagttttcagtcacagatcacgccttaaaagacataggagaattcatactggagagaaaccttacaagtgtaatgagtgtggcaaagcctttagtgaccagtcaacacttaccatcaggccattcatggtgtagggaaacttgactaatgtaatgattgtcacaaagtcttcagtaacgctacaacgattgcaaatcattggagaatccataatgaagagagatcttccgagt

SEQ ID NO: 363 - DNA, 801 bp, Homo sapiens
  misc_feature (401)..(401): Y = C/T
gtcttggatcaccacctggtgtatcctcttgcttcatgagataactccctagaaactgggcatcggagggatatactgtgggggtgacataatgcacttatctcacagctcaattttttcatttggattccagatgctactgtcattcacgatatccaggaggaggagatggaaaatgatcaaacccctcctgatggcttcctgtcaaattctgattcaccagagctgataaatatgacaggacattgtatgccacccaatgcattggattctttctctcacgacttcacaagtctcagcaaagatgagctgctttacaaacctgatagtaatgaatttgcggtaggcaccaaaaactacagtgtctctgcaggtgacccaccagttacagtaatgtcttyggtggaaactgtgccaaatacaccacaaatatctcctgccatggcaaagaaaattaatgatgatataaaatatcaattaatgaaagaagttcgaaggtttgggcaaagtaagtactgcaagaatgtctatcaatgaaagcatgagaagtgtctcattctatgatttagaacagaattgagctgcctcttgagctcattgtttggctgaattggatctatatataatttagcatggctttactttaatttcactgaaaattgctaatatgtctgcttaagtgttttgttttcctttgttagtgttcacaatagtttccttagtaatatacagatgtcgtgatttaagcattcaaaacaagcactatgtaacattgtagcccatgaaaaatgtatactgtgg

SEQ ID NO: 364 - DNA, 601 bp, Homo sapiens; identical to SEQ ID NO: 32
  misc_feature (301)..(301): S = C/G

SEQ ID NO: 365 - DNA, 601 bp, Homo sapiens
  misc_feature (301)..(301): S = C/G
ccccgcagttcttttcttgaggaggacagatagggtttcttagggagttaggatgaagaaagcctaagtatgatgaattccccatccagcactgtgcccagcacatagcagacatccaataaaggtctgttaaatgaatgacacggamccgttstttaagattttaataaaggtggggcaawgggttgaattggtcgaaaagtcctcaacgtcctgacgggactcccctgaagccaaggcagtttgagtccattcattattctgtcttggatcttaggcaaagccccgggccccttggagsagcaccagggttcccgacacccccaccgacagggtcgaacgtgcacaggctgggaccacgccggagttcattgagccctygtgggggagggcagttccagggaccaggaagggattcccgtccagtgtcaggttatccacctcgggcagctcgtcaggctgcggcgccctgttcagtctgttgcagctgagatcgagcactctgagcttggctggcagtcctttaggcacctgttccagmccagcgaacgacagattgagggagttcagggcgctggaccacatgcatctcggagcgcta

SEQ ID NO: 366 - DNA, 1374 bp, Homo sapiens
  misc_feature (1189)..(1189): S = C/G
tccaacaggaaggtgtcattgaataatccatgcacatcagtaaatagaaaattgtgcagacactaaaaattgtgttttcaaggaataatgaatgatatgagaaaatgctattatggcaagtgaaaacacacaggatacaacatcgtatagtcacaatgatctcaatttttaaatcatatttaatagtattttaaaataagaaagaaatgcatcaatgttaacagtccttctttctaggccaccaccagaaagggattatgggtaatctctctcactctcaaagtatttctgtatttccatgttatatatagaatcatatacctcccacaagcagaaactataactttaagaaaaatggtttttcaaactaatttaaggttggcgcgtcaatgaaattgggggggatccatttttgaaattagttaaaataaatcctctttctctgtgggcagcaatatggcttttgtaaggcaacactcagtgagaagcttggtggggcagaggttgcagtgacctgcacggtgttccaaacacaggtaacagctccgtgaatattcttgcctacaccttcagaatacaatgaccccttcacatttatgcagtgcagtagtgatgacaggacatttgctctcccgtgcttctgaatctcacagtatgaaataacactggggtatgcggaatcatcaacaaatggaaggatattttagctatgcctttccctcccacgaactagtgactacagggaagaaccatcttactgtgtagttgacaaagccacctttttatttgtgggaggtgggagtggttttctgagttgcagagaccaggtggccagatctacctgttagctcccagtggctgcagcttcagatgacaaagagggtggcactgctgggcaagggtgagccataggtggggtgcttttactcattggacatatgtgtgtaagtccaccatcacaaagacaatcctagtgaggccggggccaacataggccagtcacccctccttgtaaccttgatgacaatcccttgtacttaggtaggtcctttcttgctagactctttgcaaataaaaatgtataatgtgaggaaattgggtgccagtgccacctgggcctgtgggttgtcttgcctgggaggaggaagcaaactaactgaaggaaatggtcctttttccagcccgtgasctcacagccccaaccagaaggtgccaatgaagcagtccccacccccgtggtggacccagatgcacctccgtcccctccacttggcgcacctggactccctccagctggctcacccccagactcccatgtgttactggcagctcctccaggacaccagttgcaccgggcgcactacgacctgcgcc

SEQ ID NO: 367 - DNA, 1567 bp, Homo sapiens
  misc_feature (201)..(201): M = A/C
aaacctgagcaacagctcaagctttgagagtttgctcacccgtggaaagcggttgcagaagcccagtaggcatccactgctaatttgaggctgttgcatttgtattctccttctcacacactgagttcattcttcttataaataagagtatttgctctaactttgtagttcttcttctccaaaaacaacatctggacattmtttcctgaaaaatacacagcatacctctcctgagaatatttttcatctaaaaatgtaatgttttaaatcaggtaaaattaaagagtaggattgaatattaattcaagatggattaaagacttaaacgttagacataaaaccacaaaaaccatagaagaaaacctaggcattaccagtcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaatggctaatatccagaatctacaatgaactcaaacaaatttacaagaaaaaaacaaacaatcccatcaaaaagtgggcaaaggatatgaacagacacttctcaaaagaagacatttatgcagccaacagacatgaaaaaatgctcatcatcactggccatcagataaatgcaaatgaaaaccacaatgagataccatctcacaccagttagaatggcgatcattaaaaagtcaggtaacaacaggtactggagaggatgtggagaaataggaatgcttttacactgttggtgggagtgtaaattagttcaaccattgtggaagacagtgtggcaattcctcaaggatctagaactagaaataccatttgacccagccatcccattactgggtatatatccaaaggactataaatcatgctgctataaagacacatgcacacgtatgtttattgcggcactattcacaatagcaaagacttggaaccaacccaaatgtccaacaatgatagactggattaagaaaatgtggtacatatacaccatggaatactatgcagccataagaaaggatgagttcatgtcctttgtagggacatggatgaaatcggaaatcaccattctcagtaaactatcgcaaggacaaaaaaccaaacaccgcatgttctcactcatagatgggaattgaacaatgagaacacatggacacaggaaggggaacatcacactctgggtactgttgtggggtgcggggagggaggagggatagcactaggagatacacctaatgctaaatgacgagttaatgggtgcagcacaccagcatggcacatgtatacatatgtaactaacctgcacattgcgcacatgtaacctaaaagttaaagtgtaataaaaaaaaagagtaggattgaatatcatagtttgatctcccagactgggaagcacatggtgttgctttaaactcggacgccagagctgaatttttccaacaaataacaaatag

SEQ ID NO: 368 - DNA, 801 bp, Homo sapiens
  misc_feature (401)..(401): R = A/G
gcaggcattctgattggactgaacctcggaccccccatcagcttacagaccgaggagccaggcaaacctggctgcccactgggctcctttacctgtttgctgtatgatcttgggcaagccccctcaccgctctgtgcccggcttttccactgcaagaaaatggcaacaattatggtacctacctcaaagggtgaaatgaagcagagtgatgtgtgtcgggtgccccagagagcacctacctgagggaggctccaaagctagcaagaggcagcaggacagggaccaggacgcaggctgggtggagggcagtgggaggtggtcggggctccatctggccctctgagacttaaaggagctttgcttttcagagttgagaatggagagaatgttacctctcctgrctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtt

SEQ ID NO: 369 - DNA, 601 bp, Homo sapiens
  misc_feature (301)..(301): R = A/G
catcatccgaggaccgcctatctacctttatggcacggaacttcagcagctttgctgttccaggccctagccatgccttaggagatcggggcccaagccgtgttctcttcttgggaggaagatcttttgcctcctcagcccttttcctcttctgcccaacagtctcagggcggtttttctggcccttccttgtagttctggccttagcagatccctttggcctgcctctgcccctgggctgggtccgagccaccttggccttggcccgtactgccttggctttagccttggccttggcccrtgctgccatgactttggccttggccttgacctgtgctgccttagctttggccttagccttgacctgtgctgccttggccttggcccgggccttagcagccttggcctgtgttcgagccaccttggcttgggcacgagcagctttggccagtgttcgagctaccttggcctgggctgttttggtgcccagggcagagccccctttcattcgccggacactgggggacccagtggctctgttggttttgctctggtgcccagagcctcgtcggggtccagccccagggcctttgcgagtcag

SEQ ID NO: 370 - DNA, 601 bp, Homo sapiens
  misc_feature (301)..(301): W = A/T
cctagccatgccttaggagatcggggcccaagccgtgttctcttcttgggaggaagatcttttgcctcctcagcccttttcctcttctgcccaacagtctcagggcggtttttctggcccttccttgtagttctggccttagcagatccctttggcctgcctctgcccctgggctgggtccgagccaccttggccttggcccgtactgccttggctttagccttggccttggcccatgctgccatgactttggccttggccttgacctgtgctgccttagctttggccttagccttgaccwgtgctgccttggccttggcccgggccttagcagccttggcctgtgttcgagccaccttggcttgggcacgagcagctttggccagtgttcgagctaccttggcctgggctgttttggtgcccagggcagagccccctttcattcgccggacactgggggacccagtggctctgttggttttgctctggtgcccagagcctcgtcggggtccagccccagggcctttgcgagtcagacacttggggcccttgcttgtggtttttctgggagctttgggccgagggttccccggacccttcc

SEQ ID NO: 371 - DNA, 801 bp, Homo sapiens
  misc_feature (401)..(401): R = A/G
aaattacctgagtatttttctaatctgaccaatctagagcacttggacctttccagcaacaagattcaaagtatttattgcacagacttgcgggttctacatcaaatgcccctactcaatctctctttagacctgtccctgaaccctatgaactttatccaaccaggtgcatttaaagaaattaggcttcataagctgactttaagaaataattttgatagtttaaatgtaatgaaaacttgtattcaaggtctggctggtttagaagtccatcgtttggttctgggagaatttagaaatgaaggaaacttggaaaagtttgacaaatctgctctagagggcctgtgcaatttgaccattgaagaattccgattagcatacttagactactacctcgatgrtattattgacttatttaattgtttgacaaatgtttcttcattttccctggtgagtgtgactattgaaagggtaaaagacttttcttataatttcggatggcaacatttagaattagttaactgtaaatttggacagtttcccacattgaaactcaaatctctcaaaaggcttactttcacttccaacaaaggtgggaatgctttttcagaagttgatctaccaagccttgagtttctagatctcagtagaaatggcttgagtttcaaaggttgctgttctcaaagtgattttgggacaaccagcctaaagtatttagatctgagcttcaatggtgttattaccatgagttcaaacttcttgggcttagaacaactagaacatctggatttccagcattcc

SEQ ID NO: 372 - DNA, 801 bp, Homo sapiens
  misc_feature (401)..(401): Y = C/T
gaaggaaacttggaaaagtttgacaaatctgctctagagggcctgtgcaatttgaccattgaagaattccgattagcatacttagactactacctcgatgatattattgacttatttaattgtttgacaaatgtttcttcattttccctggtgagtgtgactattgaaagggtaaaagacttttcttataatttcggatggcaacatttagaattagttaactgtaaatttggacagtttcccacattgaaactcaaatctctcaaaaggcttactttcacttccaacaaaggtgggaatgctttttcagaagttgatctaccaagccttgagtttctagatctcagtagaaatggcttgagtttcaaaggttgctgttctcaaagtgattttgggacaaycagcctaaagtatttagatctgagcttcaatggtgttattaccatgagttcaaacttcttgggcttagaacaactagaacatctggatttccagcattccaatttgaaacaaatgagtgagttttcagtattcctatcactcagaaacctcatttaccttgacatttctcatactcacaccagagttgctttcaatggcatcttcaatggcttgtccagtctcgaagtcttgaaaatggctggcaattctttccaggaaaacttccttccagatatcttcacagagctgagaaacttgaccttcctggacctctctcagtgtcaactggagcagttgtctccaacagcatttaactcactctccagtcttcaggtactaaatatgagccacaacaacttc

SEQ ID NO: 373 - DNA, 791 bp, Homo sapiens
  misc_feature (398)..(398): n is a, c, g, or t
  misc_feature (703)..(703): Y = C/T
ccctaactgatatgtcctttgtctagcaattctacttctggaaattttcccacacttaaactggcacatgtgcaaaatgaaagagatttccttgcagaagagactggaaataattcaaatgtctatagtaggggtactaattatataaataatggtgtgtctatagagtagaactgtatccagctatttaaaaaacaaggatagaaagatcttccaaacatatttttaagtggaaaaagcagggtggaacagggactatacatgctatctcttgtctaaaagatggggaaattaggaatatgtatttgtttttgcttatgcatgaagatactctgaaggattcacaaaagaaaaaaaagttttctaaagggagcaagacttttcacaatttttttttngaatgcttaaaattgttgaacccaacgactgttgcctgttcaaaagttaaatttaaaattcctcccagactaggtaggggattgggcccagaagctgagaccaggctcacttgaataaatggggtaaatgactaggaattttactattccttacaggtctctcattatcttgtctttgctcccatttttatatttgcagtttaattagacacttcagaattttgatcacctaatgttgatttcagatgtaaaagtcaagagaagactctaaaaatagcaaagatgcttttgagccagaatgcctycatcktcagatcacttaatttggttctcatgggtaagtgctgctttttatcttagctcttatagaagcaagctgtgatgccatcctca

SEQ ID NO: 374 - DNA, 601 bp, Homo sapiens
  misc_feature (301)..(301): Y = C/T
gatgagtcaggctttgttctaaggtccttgacttatgctaattgaattacatttagtttccatatcaatttgataaagataacacaatttcattattcctcttatatagatgaagaaactgaagttggagggttcaagtaaccttgtttaaaggcacatggttatcaagtggcagggctaggattcaaatccaggcgtcagttcctcttaactcttccccatactgtttctttccctattgaagtgattcagtgtgagcctttggaggccccagagctgggtaccatggactgtactcacyctttgggaaacttcagcttcagctcacagtgtgccttcagctgctctgaaggaacaaacttaactgggattgaagaaaccacctgtggaccatttggaaactggtcatctccagaaccaacctgtcaaggtgagtaacttcagactagaggttttgtcatgcaatcctgggcttacagtcagaacattcagtagaagtttgctgagaagtcaaacttaggagcctaatttaacctaactttgtttaacctactgtgatgtttctcaaaggacttattctaactaaatttttttgaaaaac

SEQ ID NO: 375 - DNA, 801 bp, Homo sapiens
  misc_feature (401)..(401): R = A/G
aattttaagccattgaaaaacatataagcaaatattctaagaagataatatgtattctaagaagaatgaaccagaattctaagtctctaatgcaacaatagactaaatatctttacattcccatttacttggaaggactctgttttagttaagactaagctacctgggaaataaaaagaggacattggggctgatattctcacaaatgaaaggaacacaaagaacaaaacgggttctctatccacacatacttccacttctctgagtaagtgacttgatgtcagagaatctcacaccagattataacaataagacttttaaatgttcaggatgtttatgtttaaagcattagactgataagaaatctgatctatttcttgtatgactagatgtagtcactrcagtggaaaccaacatacgaaagagcaggcggcacattttcatcctgacccctcagatcactcacaataaggagtttgcctacgagcaggaggttgccctgcactgtgccctcatccagaacgacgccaaggtgatacttattgagatggaggctctgagcgagctggacatgctgcaggctgaggcgcttcaggactccctccagcatcttatgaaagtacaggggaccatcaagtggagggaggaccacattgccaataaaaggtccctgaattctaaattctggaagcacgtgaggtaccaaatgcctgtgccaagcaaaattcccagaaaggcctctagtttgactcccttggctgcccagaagcaatagtgcctgctgtgatgtgcaaaggcatc

SEQ ID NO: 376 - DNA, 801 bp, Homo sapiens
  misc_feature (401)..(401): Y = C/T
aaccagaattctaagtctctaatgcaacaatagactaaatatctttacattcccatttacttggaaggactctgttttagttaagactaagctacctgggaaataaaaagaggacattggggctgatattctcacaaatgaaaggaacacaaagaacaaaacgggttctctatccacacatacttccacttctctgagtaagtgacttgatgtcagagaatctcacaccagattataacaataagacttttaaatgttcaggatgtttatgtttaaagcattagactgataagaaatctgatctatttcttgtatgactagatgtagtcactgcagtggaaaccaacatacgaaagagcaggcggcacattttcatcctgacccctcagatcactcacaayaaggagtttgcctacgagcaggaggttgccctgcactgtgccctcatccagaacgacgccaaggtgatacttattgagatggaggctctgagcgagctggacatgctgcaggctgaggcgcttcaggactccctccagcatcttatgaaagtacaggggaccatcaagtggagggaggaccacattgccaataaaaggtccctgaattctaaattctggaagcacgtgaggtaccaaatgcctgtgccaagcaaaattcccagaaaggcctctagtttgactcccttggctgcccagaagcaatagtgcctgctgtgatgtgcaaaggcatctgagtttgaagctttcctgacttctcctagctggcttatgcccctgcactgaagtgtgaggagcagga

SEQ ID NO: 377 - DNA, 801 bp, Homo sapiens
  misc_feature (401)..(401): Y = C/T
tgtcagagaatctcacaccagattataacaataagacttttaaatgttcaggatgtttatgtttaaagcattagactgataagaaatctgatctatttcttgtatgactagatgtagtcactgcagtggaaaccaacatacgaaagagcaggcggcacattttcatcctgacccctcagatcactcacaataaggagtttgcctacgagcaggaggttgccctgcactgtgccctcatccagaacgacgccaaggtgatacttattgagatggaggctctgagcgagctggacatgctgcaggctgaggcgcttcaggactccctccagcatcttatgaaagtacaggggaccatcaagtggagggaggaccacattgccaataaaaggtccctgaattcyaaattctggaagcacgtgaggtaccaaatgcctgtgccaagcaaaattcccagaaaggcctctagtttgactcccttggctgcccagaagcaatagtgcctgctgtgatgtgcaaaggcatctgagtttgaagctttcctgacttctcctagctggcttatgcccctgcactgaagtgtgaggagcaggaatattaaagggattcaggcctcaggtttcatctggtaactttccttccatttccctgcttctgggtggatgcaaaatggccagaaatttttctcctcaatcctccaccatcctccagccaccattttcttcccttttcccttttgcttgcctgtcttcactgtggtgtgggatgttttcactactcttttttcctctctctctgtcttgc

SEQ ID NO: 378 - DNA, 601 bp, Homo sapiens
  misc_feature (301)..(301): Y = C/T
gcttatcatgtatgcctaacatgacaaaaaagagcctatcattgcagccagtatgataatactcagtctgtggggcttcttatttgcttattccatcatcatctgtcctgcttgatgtctttgcctatgcacaatcatatgacccatcacatctgtatgaagagctggatgactaggattaatattctattttaggttcttattcagcagaaatattagataatcaatgtctttttattcctgtaggtgtgaaatccagacaattgaagatggggcatatcagagcctaagccacctctcyaccttaatattgacaggaaaccccatccagagtttagccctgggagccttttctggactatcaagtttacagaagctggtggctgtggagacaaatctagcatctctagagaacttccccattggacatctcaaaactttgaaagaacttaatgtggctcacaatcttatccaatctttcaaattacctgagtatttttctaatctgaccaatctagagcacttggacctttccagcaacaagattcaaagtatttattgcacagacttgcgggttctacatcaaatgcccctactcaat

SEQ ID NO: 379 - DNA, 201 bp, Homo sapiens
  misc_feature (101)..(101): K = G/T
aaatggctggcaattctttccaggaaaacttccttccagatatcttcacagagctgagaaacttgaccttcctggacctctctcagtgtcaactggagcakttgtctccaacagcatttaactcactctccagtcttcaggtactaaatatgagccacaacaacttcttttcattggatacgtttccttataagtgtctga

SEQ ID NO: 380 - DNA, 601 bp, Homo sapiens
  misc_feature (301)..(301): Y = C/T
ctgggtgacagagcaatattccatctcaaaaaaaaaaaaaaagatgtaatcttgcccaacaggtacaataaaagattgccaatgtatagatgtgggcatgtgtaagggacagtggtgaggatgttccggctgttgtgggagctctaggggaaggtgagaaagctaggagtgggaaaactggcaggggcagaaatgagggggtggggaaatggtacggaggttcataactgaggaatgaccacgactgcactatttcaggagcagacaagatggagacaaattcctctctccccacgaacayctctggagggacacctgctgtatctgctggctatctcttcctggatatcatcacttatctggtatttgcagtcacctttgtcctcggggtcctgggcaacgggcttgtgatctgggtggctggattccggatgacacacacagtcaccaccatcagttacctgaacctggccgtggctgacttctgtttcacctccactttgccattcttcatggtcaggaaggccatgggaggacattggcctttcggctggttcctgtgcaaattcgtctttaccatagtggacatcaacttgttcgg

SEQ ID NO: 381 - DNA, 370 bp, Homo sapiens
  misc_feature (171)..(171): W = A/T
tgaagaattccgattagcatacttagactactacctcgatgrtattattgacttatttaattgkttgacaaatgkttcttcattttccctggtgagtgtgactattgaaagggtaaaagacttttcttataatttcggatggcaacatttagaattagttaactgtaaatwtggacagtttcccacattgaaactcaaatctctcaaaaggcttactttcacttccaacaaaggtgggaatgctttttcagaagttgatctaccaagccttgagtttctagatctcagtagaaatggcttgagtttcaaaggttgctgttctcaaagtgattttgggacaaycarcctaaagtatttagatctgagcttc

SEQ ID NO: 382 - DNA, 601 bp, Homo sapiens
  misc_feature (301)..(301): W = A/T
acaacaggtaaaaaactgactccaattcttggtaaacacaagttggagaattgggtgagaagcaagagtccacttcaatacttgctcaatgggatgtgcttttttccaactgggcactacactggaaaatctgggttatacaagcagacaaaatggcttgtttgtgtcagtgggaaataaattctaagagacagactgggtgaagactatgataatttatgagttccagtttgcaactctttacctaaacctgggattctaggatatagagatcctttatgcaaggggagcagaagtatgwtcctccagaaccgctcaataaaattggttctaagaaaaagccactgcatttcaaaactgcctgaagtatatctttcactccactttattattgtattctgaacatggcacctctgcaacttttgtttccatatcctttgagcgtcttctagaaagcaaagcttgattctgccttctgggcttgagcatgtgggcatagctgggttgtcctgcactgcctgaagagctgcaagagacaaggaatatcatgaacagtggtatccctctttgttcttatagcctcacctatggaggaagctac

SEQ ID NO: 383 - DNA, 601 bp, Homo sapiens
  misc_feature (301)..(301): R = A/G
cctgaaggtcccataaggtcttgcctccaagtcctgcccccacccacctccatgtcatctcatcgtgtttttccagatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcraggtgaccgtgaatgtgctctgtgagtgagccggcgggcagagctgggtgggggcaggggccatggacctaatgcaatcctcaccgcctgttgtatcctccccacagccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcc

SEQ ID NO: 384 - DNA, 601 bp, Homo sapiens
  misc_feature (301)..(301): S = C/G
tcccccatgctcccctgccccatccccttttccccttcccgtcttctcatccctccattcccatctttccccagcaattaccagctctggctgggtcgccacaacttgtttgacgacgaaaacacagcccagtttgttcatgtcagtgagagcttcccacaccctggcttcaacatgagcctcctggagaaccacacccgccaagcagacgaggactacagccacgacctcatgctgctccgcctgacagagcctgctgataccatcacagacgctgtgaaggtcgtggagttgcccaccsaggaacccgaagtggggagcacctgtttggcttccggctggggcagcatcgaaccagagaattgtatgtgggggcagactgtgtagcccaaggcggggatggggactcctgcgtccaagggagaaagggccagggaagcaggtgaggtcgggctgcagccctttttctcccgggttcgtagtctcatttccagatgatctccagtgtgtggacctcaaaatcctgcctaatgatgagtgcaaaaaagcccacgtccagaaggtgacagacttcatgctgtgtgtcggacacctggaaggt

SEQ ID NO: 385 - DNA, 601 bp, Homo sapiens
  misc_feature (301)..(301): N = A/C/G/T
gcctgacagagcctgctgataccatcacagacgctgtgaaggtcgtggagttgcccaccgaggaacccgaagtggggagcacctgtttggcttccggctggggcagcatcgaaccagagaattgtatgtgggggcagactgtgtagcccaaggcggggatggggactcctgcgtccaagggagaaagggccagggaagcaggtgaggtcgggctgcagccctttttctcccgggttcgtagtctcatttccagatgatctccagtgtgtggacctcaaaatcctgcctaatgatgagtgcnaaaaagcccacgtccagaaggtgacagacttcatgctgtgtgtcggacacctggaaggtggcaaagacacctgtgtggtgaggcagccctgcccccagggtctggaagggctgagggaggggactcagcctctgaactggcttctgagagctaaccaggcatctgcttcactgcttcccagctagctgtagccactcgccccatcagtgccccagctccccctccttcccccgcccatccagggacaactgcatctcaccccccacaccagagttcaccgttcctcgtggtaatgtgttg

SEQ ID NO: 386 - DNA, 801 bp, Homo sapiens
  misc_feature (401)..(401): Y = C/T
tattgcttcctcccacaatttttccttaaaacaaattctatttcttttcagaatacatcctctgttagccactaagcattattcattagccataatccactgaacaaatgtcagttcatttacagtacattttaccttttctctcattaatcttccaaattattgaaaatagtccagaattttatcgatacttttataattttatgtacagagaaccatcattttagataacttgagattcagaaaaattttagtttgtcagttttaagacaaaaaaggaaccagtatcaaggggaaaaaaatagaaataaagagaaaatacttgatatctaaatcacgcccttttgttgtatgctcagttatattaacaggttacatggatgaagaacttgcaaaaaaaycttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgt

SEQ ID NO: 387 - DNA, 801 bp, Homo sapiens
  misc_feature (401)..(401): R = A/G
tgtatgacactaaagacccagctgtgaccgagtgggttttggctgagctggtggccaaactggaagacccaagagagaaacattttaatttatgtctcgaggaaagggactggttaccagggcagccagttctggaaaacctttcccagagcatacagcttagcaaaaagacagtgtttgtgatgacagacaagtatgcaaagactgaaaattttaagatagcattttacttgtcccatcagaggctcatggatgaaaaagttgatgtgattatcttgatatttcttgagaagccctttcagaagtccaagttcctccagctccggaaaaggctctgtgggagttctgtccttgagtggccaacaaacccgcaagctcacccatacttctggcagtgtctraagaacgccctggccacagacaatcatgtggcctatagtcaggtgttcaaggaaacggtctagcccttctttgcaaaacacaactgcctagtttaccaaggagaggcctggctgtttaaattgttttcatatatatcacaccaaaagcgtgttttgaaattcttcaagaaatgagattgcccatatttcaggggagccaccaacgtctgtcacaggagttggaaagatggggtttatataatgcatcaagtcttctttcttatctctctgtgtctctatttgcacttgagtctctcacctcagctcctgtaaaagagtggcaagtaaaaaacatggggctctgattctcctgtaattgtgataattaaatatacacacaatcatgacattgagaagaact

SEQ ID NO: 388 - DNA, 801 bp, Homo sapiens
  misc_feature (401)..(401): Y = C/T
ttaaggcttttaagaacacctgaattctttccttctgcaaaaccagaggcagcttcttttccgcctattttcagtttatttcttgtgattttagtttttttctcttaaccaaatgctaaatggatttaggagaaataaacttatttgtaaagctgtcaagggaccattagaaggatggtgcttcacagatagaatacagtttttattaatgatgcctagacaaatcctgccattagcccaagggctcagaaagttagcagcctagtagttttggagttgtcaatgaaatgaattggactggatggttaaggatgcccagaagattgaataaaattgggatttaggaggacccttgtactccaggaaattctccaagtctccacttagttatccagatcctyaaagtgaacatgaagcttcagtttcaaattgaatacattttccatccatggattggcttgttttgttcagttgagtgcttgaggttgtcttttcgacgtaacagctaaacccacggcttcctttctcgtaaaaccaaaacaaaaaggctttctattcaagtgccttctgtgtgtgcacatgtgtaatacatatctgggatcaaagctatctatataaagtccttgattctgtgtgggttcaaacacatttcaaagcttcaggatcctgaaaggttttgctctacttcctgaagacctgaacaccgctcccataaagccatggcttgccttggatttcagcggcacaaggctcagctgaacctggctaccaggacctggccctgcactctcctgttttttc

SEQ ID NO: 389 - DNA, 602 bp, Homo sapiens
  misc_feature (27)..(27): n is a, c, g, or t
  misc_feature (37)..(37): n is a, c, g, or t
  misc_feature (76)..(76): n is a, c, g, or t
  misc_feature (302)..(302): R = A/G
ttagtgatgtctaaaaaagctaaaaanaaaaaaaaangagcactgcattcaattagtgatgtctaaaaagggtagnaaaaaaaaaaaaaaarrawaaagaaagagcaccgcaatcaattagtgatgtctgaaatggagcagaccaggagagcaccacgaattttgccctccataggttagctcatctctgaggtctttccctgctctgacatayttttgttccatgattacctccagcctggtggggaacaacattggcagtgtgggtgcccaagccttggcactgatgctggcaaagaacrtcatgctagaagaactctggtgagtttgggggattctctgctctggggaagtggatcacaatctctgttgatcccctggcctcatccataggagcggttgtgtggacagacaaaggtggatgattgagtgattgactgattgattgattgtgtttgtctttatatgtactgagtggtatgaagcttatagagcctggtatgtacatgctaatttttttatttaataaaatatatgggtttgctggtttggtgactgcctccacatggcataagtgttaagagcacagactctgtaatcaa

SEQ ID NO: 390 - DNA, 201 bp, Homo sapiens
  misc_feature (45)..(45): n is a, c, g, or t
  misc_feature (101)..(101): R = A/G
cctgtgcctggcctggcttccctggcgggggcggcaaagtgggcnagatgaggatgccctgccctacgatgccttcgtggtcttcgacaaaacgcagagcrcagtggcagactgggtgtacaacgagcttcgggggcagctggaggagtgccgtgggcgctgggcactccgcctgtgcctggaggaacgcgactggctgcc

SEQ ID NO: 391 - DNA, 801 bp, Homo sapiens
  misc_feature (401)..(401): N = A/C/G/T
tgcagcacaagcctggtataactgaattgggaaatgttttattgactcagtaatgccactgtctctctacaagataactctggatgacttcctataacactttccttcacctttcttgaaactaagactaaatttttttttggcaccctgttgtttgtcacggaattccttaagaaactccttaagtatttatttattgactttccaaggtaccatgatagttaattacatagtcgaaaatcagtgatatggtgtctttcaggacatgactacagagctggaggcatttgcacaccgcccagagcacaagacctctgacagcacgttcctggtgttcatgtctcatggtattcgggaaggcatttgtgggaagaaacactctgagcaagtcccagatatantacaactcaatgcaatctttaacatgttgaataccaagaactgcccaagtttgaaggacaaaccgaaggtgatcatcatccaggcctgccgtggtggtgagtgctgatgcctttgagaacaccagacaatcaaatactatcctactctgtatgcatccaagaatttttggtttcttttggtttgtcttttaatgtcaaagaacacatactgtcagtattcaagaatgcagcttctgtgaattgaatggctggttggtagatatttattccatatttaagcttgagattttgatgtttggaaatttttacaatttgtttgatggttagaaaagataaacattgttgaaaagattgtaactgaaatgcatgtgtctatttgcatgtgaattaatgatagagc

SEQ ID NO: 392 - DNA, 801 bp, Homo sapiens
  misc_feature (401)..(401): Y = C/T
cacagttaaaaaatgctggtctaccaggcatcttactgtacaggctctccttctagctacaactccatgaataggccttcttgatatctcaatttctcttttctttttcctttttttttttttggtagagacggggtctagctatgttgcctaggctggtcttgaactcttggcctcaagcagtcctcatgccttggcctcccaaagtatcaatttcccctttctgtacaacggtcctaagggattatcccaggaaagaccacaacaatttgtttatgctccaatgtacggggtaaactcttagctattgggaagtggtagggcctgcaggaggtagagagtcgccatagctctgattgctggacttctctttgggctcctgtcttacaggccctgcctcygggctcacctcgctgtgacctgaaggagaatctgctgaaggataactgtgccccagaatccatcgagttcccagtgagtgaggcccgagtactagaggacaggcccctcagcgacaagggctctggagacagctcccaggtcactcaagtcagtccccagaggattgcactccggctccggccaggtagggctgggactctttgcggggagagacctgaagcaggtgggcatagagcacaaggtggaggtctgaggaggaagtcttggggaagtagctcagaatggaaatggggtgggaagacaaggatgaggggggaggtgtgggcaagagaatggaagaaaataagagacgttaggacttgagtcagaagatctgaggtgaatctttactgtatcata

SEQ ID NO: 393 - DNA, 801 bp, Homo sapiens
  misc_feature (401)..(401): B = C/G/T
cccgagaatggagagtttctctaattacaggaaacaaaattaaattgggcctaaaggcatttttttttttgtaattgcagttggtttaaaaattgaaaaagaatattcactcaaacaccttggctttaaaaatattggtttgctccccactgttaaaaaggcattgagacctgcagcaaacttcattctaatgagggtccagatgatttttttttttgtagatgtgtagaacaactctgtgggaaaaatgatacctcaaagattaatgatgttctgtagtagggaaaataaaacaaatagtttttatttgaacctttttattgtatgatagaaaattttgatttaaatggcgagtgagatatgcttaccatctctcttttttcctatttatagtagctctbaaggtcaaagaggacacactagcatgaaagccgtgtacgttgaacccgctgctgctgctgctgctgctgctatctcagacgtatgtacattgaggaccatagactacaatcttagacccttatccgtgtgatgttgattatttagttaatgtgtgttaccaagaagtatgtcatatggatgtgacacatgagcagtgttccacagttgccatcttgtagacatttcttattaggagccagtaactgccagacttcgaatggtccctgtagtgcttgaaaaagaattaagctaagctgtatcccagatgttgttcagggtctttttgccttgtgagtacatttcataatggaagtttacttactgacctgcctggtgtagaaagccatgaaggctagaacc

SEQ ID NO: 394 - DNA, 801 bp, Homo sapiens
  misc_feature (401)..(401): K = G/T
ttcagtcacaggcatggccaattattctacaaggaatagatcttatagtagttgcacaaaccggaacagggaaaacattgtcctatctaatgcctgggtttattcatcttgattctcaaccaatatctagagagcaaaggaatgggcctgggatgctagtccttacacccactagagagttggctcttcacgtggaagctgaatgttcaaagtattcatataaaggtctcaaaagcatttgcatatatggtggtagaaacagaaatggacaaatagaagacattagcaaaggtgtagatatcattattgcaactcctgggaggctgaatgacctacaaatgaataactctgtcaacctaagaagcataacctacttggttatagatgaggcagataaaatkctggatatggaatttgaaccccagataaggaagattttattagatgtgcgcccagaccgacagactgttatgacaagtgcaacttggccagatactgtacgtcaactagcactttcttatttgaaagatcctatgattgtttatgttggtaatctgaatctagtggctgtaaatacagtgaagcaaaatataattgttaccacagaaaaagaaaaacgagctctcacccaagaattcgtagagaacatgtcacccaacgacaaagtcatcatgtttgtcagccaaaaacatattgctgatgacttgtcaagcgacttcaatatccaaggcatatctgcagaatcattacatggcaacagtgaacagagtgatcaagagcgagcagtagaggactttaaaa

SEQ ID NO: 395 - DNA, 801 bp, Homo sapiens
  misc_feature (401)..(401): N = A/C/G/T
agctaataaacaacaaatattcaaatatgatactattgatttcagtataattagacttttgcctggatgaagcacagaatacaaaaagaaaagccaaagtggaagattatgcatcacaatgttaattatttcgcatcagggttgtggcagtgaaacttaacacttttttttaaaacataatgcgccttacactattccaattagcaccacttttaaaactcttttttaaaaaagaacctaagaactctcaagattttcctgggaagtatttgtactgtctttaatttgcaactgcaaaataccttgtccagacataatattgcataaaagccgacttgaattttttctttttcatgtaaggggttgtttattaaaaccagctgtaccttgatcagtccagnagtttcagccaggctcaccgctaacttactgtcttcactggccaccatcacattctcctctagagcgtggaactgcaacacctccatctcttgcggggagtacagctcttgctggatactaatggccacacactgctgcaggctctgccggggcccttcctcaagccacagcaacccagggccaggctgttgcaccaccacctgcaccccttcttgctgctgtatgctcagcaagctcatatcctgcaactccacagcttcagaagtgaagtgcaccgtctgcagggtcaggatgtacttctcgctctcctccgagggggccagcaccagctccacttcttcctccaggacgctgtcctggaaggccccagaggtacgctcggcctccaactcactaggg

SEQ ID NO: 396 - DNA, 601 bp, Homo sapiens
  misc_feature (301)..(301): R = A/G
gaggagggcctggatgtggagcctcagataccaagtgcttcccttcaggccgggccgcttgctcagagccagcacacagggatgcccggatcacgggggccctgagagggtcccctgctcacagcctccttccctctctccttctgcctcagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccrgtaagtgagggtgatgtcccaggcagccttgccggggcttacagggggagacacctagtgccacggaaatgccgaggctggtgccaaggcccccaagggtgacaaggttggggctggggctgggcccctcggaccccaggccacagactgacagggcaccggcttcttccactgctcctagaacttactgactggctgggaggtcctcacagccttctcacgtcccctggggcttccaggagccgtagagtttctgggcgaagcgtccgggacggaggccccaggcggccccagccaatg

SEQ ID NO: 397 - DNA, 801 bp, Homo sapiens
  misc_feature (401)..(401): S = C/G
aatattacactaaaaggtggggttctttggggagtctgataactccctattgtaagattttgtgtgttggattgtccttttttttttttttaggggatgaggagaccacactttcataggattcttcaagaattttgtgattttaaaaaactaataaccactttcctaaggcatgacagatgctcctgaagtcctggcaggtttctataatcgggtttaaactctcctggtgtgacactgtcctcctgagatagagggatctttccatgggggatttactgtgacttaagtaagcttacccagcgggaaaagcctttgccacacttggagcatttgtaaacagtcgggatgaaatttgcatcgtggtatttcctgaagtgagcgtttagaagttgcttctstcggaaacatttattgcaagaaaggcaggtgaatggtttctctccagtgtgggtacgaatgtgagcggtcatatgacgttcctaagagggaaggggaagaaagcagcttgtctagttcaaagggttttctcgatattagacactgtttatcatacaataccttttatttccctccccaaagatgagtccactattaagcagaattactgcaaacacattctgaacaaggcagcattcactctcagtaagtggccgcctaggaaacaaaactcgtatgcagcagcaagtgacaaaggtcttgcagtggattccttgctggctctcctgtcctgttgggatgtgggagtacacaccgcagggcgtgaaaggatggtcctttgtcctctcattactgggagtc

SEQ ID NO: 398 - DNA, 801 bp, Homo sapiens
  misc_feature (401)..(401): S = C/G
tgtaccttgatcagtccagtagtttcagccaggctcaccgctaacttactgtcttcactggccaccatcacattctcctctagagcgtggaactgcaacacctccatctcttgcggggagtacagctcttgctggatactaatggccacacactgctgcaggctctgccggggcccttcctcaagccacagcaacccagggccaggctgttgcaccaccacctgcaccccttcttgctgctgtatgctcagcaagctcatatcctgcaactccacagcttcagaagtgaagtgcaccgtctgcagggtcaggatgtacttctcgctctcctccgagggggccagcaccagctccacttcttcctccaggacgctgtcctggaaggccccagaggtacgctsggcctccaactcactagggctccgatggtctttctctctgcacactccgtctttttcctcctccttcaggcctttttccggcatcaactcgagttctttgatcttggtgaattgctcagaaaggacagagatctcagtggctgccataatgacttggcctgtttgaaaaataagcaagcggtttccataggggggagaagggggtggtatgaggagggatgcggggggtgctggaacctagcaggctttggagttgaaacaaggtctggcctcaaaaggttttggacttagtagggtcagaacaatgctgatctggcttgggtctaggagggggtcaaggctaagcaggatttaggctaaagcaggattttgtacaaaaccctagaacgaacaggtttgg

SEQ ID NO: 399 - DNA, 601 bp, Homo sapiens
  misc_feature (301)..(301): Y = C/T
tgggaacccagcctctcctattcccaagacacccaaactcccagcccttagccctcccctcctcccagactagcctggttctccaggctcctcctcctcagaccctggagttccagcctccagttcccttctcccccataatatcaggaagtggaaccttctctctttagccctcagactcaggaggccaggcctcccctttcctcctccagcaggactcccacctagcctgaaggtcggatggatctgagcttctcctggcattccctacctcctctggcctcccggggggccagccacyccctagaggagccccaggcttctgattccaaggtcgggttttcttccatggcccaggctgggctgtctctagtggccaccaggcagacactgccccaggtaagggaggggccaggggcaggtgtgtacctggccagcaggtggcccggagggagtaaggtacacttcctgtggtttctcagggccgctgatgcgaaaggtctcctgggagctgaagtccccgtggtgccccgggcctcacagtttggttcctgggctgggcgggggggctgtacctcaccctgggacttggtggactaag

SEQ ID NO: 400 - DNA, 998 bp, Homo sapiens
  misc_feature (500)..(500): Y = C/T
acaggacccttagaggaaactggggtcacagagaagccacctggggcagcttcgggtggagtaagggaagatcacccccaagcgtgatcccttggcaggtgtgtgtggcagttcctgatcgggagcaagctgctgcccctcctggcccggattcctgccgttccactcagccaccaccactcccaccaacccctctagaaggcctatgtcatattccaggcactcattgaatcctcaagacaaccctagaaggcaggaattattgttacccccattttacagatggggaagcaaagccacagcagtgttcaccactgtgctatattcctcccttctcctctgaggctccctgccacctctctagcaccccctaggtcccctagcactcctgggtccacgctgtcctcaaccccatctccctcccaggcaggccctaacttgctggcctccttcaggagggcgatggcaatacgaatccgctgccgcaggaagatgagcaycagcagcaggatggcttcaagcaccgccaacacgatcactgcagaggacggggcagacagacctaggtcagggccagggctggggccgggcatggcccagggcggtccttgggcagctggtggcttgggggtgggcaggacactcacgggcggccagccaggtctcctgcacgctctggtaggcactgaggttggtggtgaaacccagctgggagatggaggcgcccttgtcccgcagcactcggtactcctcccagcagtagtagatgccgtatgccagcacgcccagcactcccaggatcagcaccagcaccaggggcccagccaccaggcgcagaagcaagataaacagtaggctcaagaccagagccacccccagggcactgtaggcagggtgaggacagtgaggttcagccctagcccctcaaatctttccccttacagaggccctccctgcctttccacacaccacccaatgtccccagattaggctctttc

SEQ ID NO: 401 - DNA, 741 bp, Homo sapiens
  misc_feature (401)..(401): S = C/G
ggcaaaatgagggtgttggggtctgaagtgtggtgctgaggaggctcaggctctggtcttactcctcccctgagccagatatgcttcacctccaactccctcccaggatgggggtcccacctcagccctaccctgcggccctcgggccttcccctctggctggtcctagagccagagatttacctgtcacatgcacagagagcttgtcatatatgtagttccatttcctgcttcctctctccacctggaagtagtacttccctgaatcccccttcctggcatctctgatgctcagggagcagttgttggtctgtgggtccccaaggaggaggaatcgaccstgggtatcctcttgcacttttccacttggggtgtttgtggccactggaatatcccatggtatatcggccccttccttgaaccaggatccataaacagggctagaggcagtccagttgtaatgggggtaaaggacactgcagggcacagagacacacagaccctcctgcacagtcaccgactctggcacctccagcctgtatcttgacagtaggtcctgggacgctgtggagaaacgagggtcagcccagcccccactgtccctctcttcatttgcccatagcaggggcagcagcatctctgaggcagaggcttcctgggctccctgtgtgagcagagaagggggagggagaggaggggcagggctgtgggacccacagggggctggagaggagctggaga

SEQ ID NO: 402 - DNA, 690 bp, Homo sapiens
  misc_feature (201)..(201): Y = C/T
agaccaagttgggctggaacttggttccctgactcacattggctaccactcccacctcactgcccctcactccacctctggacaagaggtccacacattctgtacctgatttacaagctgtacatgggaggcaagcaaacaaattgttggaagcattggtgtaacccacaccctctgtgcaccggttacaggctccaggaygttctgatctatgagatcctgggaagggagagaaaagccaatgaatgaattgccacagagttcccagaggatcgtggcggtggctaggaaactcttcttttggccatcagtagaccccagacagagaaatcccatcttcttggcttggtcttgtcgtcaattctgcatctatacacacctctgactggcgctgctgacagaaatacaatacaaaccacatgcaaaattcaaattctatgagagccatattaaaatagtaaaaagagaatgaggtcaaattaattttaacaatgtactttttggacctaaaatatccaaaacattagcatttcaacatgtaaacaagataaaacattgagatattttcttttattttgaatactaagtgttcgaaacccagagtgtatttttcactcactgcacatctcaattcaaagtggctgtgttttaagtgattaatggccacataggcctagagaccagggcaat

SEQ ID NO: 403 - DNA, 801 bp, Homo sapiens
  misc_feature (401)..(401): Y = C/T
ggtggtgccgcggggttaggatgctgagcctggcggtgctgtacgtgggcccaaccttggggtccagatgcactgtgttatggcagatttgaccctggcaggttggcccctggcagggcaccatgggcatagctgaccgcatctgaacccccactgaatgctccatctccttggctgagtgagtgatgatggatgctagctcctgaaactcgtagaaggttccagaatgcccctcaaagaccaggagcacatccacaccagccacggcctctgcaggctggaggctggccaagtgaatgttagcccgtttgatgtccagcttatggctgaggaacctctgcaggttccgccagtggtcactcaccagctcctcgggggtgagctggtagaagcccatccayatggcctgctgcagagcctcctgccccacatgccacacgtacacatggaccccagcagtcgtggtgaaggtcccatcgctgaccgtgacgttgaacgagtagtggccacgaggcaggccctgggcggcgataatcttgccatcaggcgcacccactgagaagtgcctgcccagggtctcctcttctgccaggctataggtcagcgtgtcctgggggtctcggtctgtggcatggatcttacccaccatgccaccctggaactcatcctctccaacagtgatgaagatctccagtgggagagcagaaggtgcatagtggctctgctctgtgacatggacacggacagacgtcaaagacgagaggggagggatgccactgtctgacgcctgtgggcaaaaca

SEQ ID NO: 404 - DNA, 801 bp, Homo sapiens
  misc_feature (401)..(401): S = C/G
acaggcagagataaacacagtcatcagctccttaaacttgattttattgtaatcatcgccatcagtggtgatgatttgtccaatttggtttctccatgtgtgactaatcctccccactgtcctgtgaagatccttcagataagcctaggtcttcatcctcctgtgaggatccttcagatgagtctagatctttgtcctcctttgaaggtccttcacatgggcctaggtcttcatcctcatttgaagatccttcagataagtctacgccttcgtcctcctccttttggattggattgatggagttctcttgggactgttcattctccagttgatttgaatttattttcttacccttcctgaggtaatacacaaatattattggatattctgatgtttttgtsttcttcaaactctgttcgggggctaagactctgtttggtacctcttgcatctggtaagaaaatagggagaggccagaaagacattattttgggtgaataggatagagactagatagcaaggggggctttatgagaaggaatgcaggtggaggaaggggtgtgtgccagagaagaacaaggtgaaatcatagggtaggtatctatgcagaagaagaagaggagcatgggtagagtcacctgttagtccaaactgcatgattttgtaagtttttgctatgttgcagaccttggtcaaagtgaaacattccatgggggttcaggccatgagcaacatcctgcctaaccacctgaccacaaggtggacaaaggctcaactaaagaaacatccctatcataagtc

SEQ ID NO: 405 - DNA, 401 bp, Homo sapiens
  misc_feature (201)..(201): M = A/C
gagggcactttgtcttccaattacatgctgatttgctaggtggctcaatgacaaggtaattaaggcgaaggaaacaaatgtagcaggcacagcgtggggtggacagtcagctgtcggtggcttctgctgagatggccagaggactccaggttcccctgccgcggctggccacaggactgctgctcctcctcagtgtccagmcctgggctgagagtggaaaggtgttggtggtgcccactgatggcagcccctggctcagcatgcgggaggccttgcgggagctccatgccagaggccaccaggcggtggtcctcaccccagaggtgaatatgcacatcaaagaagagaaatttttcaccctgacagcctatgctgttccatggacccagaaggaatttgat

SEQ ID NO: 406 - DNA, 602 bp, Homo sapiens
  misc_feature (301)..(301): K = G/T
  misc_feature (311)..(311): n is a, c, g, or t
taacttttcagagagggagaagcagacttgtggagctgaagagaaacacccagaagctcaggtgaaagctgacacggccatagttggttcatattaaccatgtgattaaaatggttaaatattaatttgggttcttacatatcaaagggtaaaattcagagcaagggagaggtagacaggacctgtgaaaagcagtggttagtttagggaaaatacctaggagccctgtgatttggagagtgaaaactctttattaccgttgttactttaactctttccaggatggcctgcctccttcgckcatttcagangaatttctgcaggggttttcttcttagcwctttggkgcatggttgtaggtgacaagctgctggtggtccctcaggayggaagccactggcttagtatgaaggatatagttgaggttctcagtgaccggggtcatgagattgtagtggtggtgcctgaagttaatttgcttttgaaagaatmcaaatactacacaagaaaaatctatccagtgccgtatgaccaagaagagctgaagaaccgttaccaatcatttggaaacaatcactttgctgagcgatcattcctractg

SEQ ID NO: 407 - DNA, 601 bp, Homo sapiens
  misc_feature (301)..(301): Y = C/T
cgttgaagatgccgcatctcaaattccaaggtatccctttcattttctatgcttcttacgtaattttctaaaagtattttgtcttcagtaagtctactgatgctgttttcaaattttatattttcttgactatgtttctttagttcttcttttagaatctgattatctgttttggtttccattaccatttttgataacatttcacattccttgccaatttctgacaagctattcttataaatacttgcttctgattttgcattttttatttcttgcagaaaattctcttcggcagtagatyggtaggtttgaatattctcaatttctctttccataatttgtctggcagcagtagattcttgtaatgttgtttcaaggttgagtttttcatctttaactgtttctattatttgaagaagtgtctcttgttccgtttttgccaatctttctttctcttttagctggattatctctagctggctttcttttagttcatttccaagtgagcttttttcttttagaagctggtgtgtttttttctctaacatttctttttcatcttgtatcaacagaatattggttttcattgcttccatttcta

SEQ ID NO: 408 - DNA, 801 bp, Homo sapiens
  misc_feature (401)..(401): R = A/G
attgaaaccaaactctggaaaggacccaatgtaccagtatttatacctctaatgaagcacagagagaggaagagagctgcttaaactcacacaacaatgaactgcagacacagctgttctctccctctctccttcccagagcaatttatactttaccctcaggctgtcctctggggagaaggtgccatggtcttaggtgtctgtgccccaggacagaccctaggaccctaaatccaatagaaaatgcatatctttgctccactttcagccaggctggagcaaggtaccttttcttaggatcttgggagggaatggatgcccctctctgcatgatcttgttgaggcatttagctgccatgcacctgtccccctttaatactgggcattttaaagccatctcragaggcatcttctacatgttttgtacgcattaaaataatttcaaagatatctgagaaaagccgatatttgccattcttcctatatcctggaatatatcttgcatcctgagtttataataataaataatattctaccttggaaacttgtgtgtgtgttgagtggaagaggtttggaagcagtaatgtgggtaagagaagctggtccactgggtgggttccagcctggatttggcacgggcttcctgaaagctgggccccctcctcacaggttcagtcctaagcagggctgcaggcagaaccaggaatactgacctcagctacagacactcaggagactgcccttctctggccatgtccaatcttttcttggttgtgccatgctcctgggtcctggtccagt

SEQ ID NO: 409 - DNA, 501 bp, Homo sapiens
  misc_feature (251)..(251): M = A/C
aagtacaccctggcctgagagagtttgaccttcctgatgctcagccggcccaggaggaagcagagacgggcatgggcccaggtcatgtggctcttcttggcccactttcttgatgcctccaggtaggccacaaactcatcctcctcagagaagctataaaaggaagaagtgaggaaagagaaggagaagtcatagagactcttaaagtggtcagcataaccctcatgatccagaaaagccaatatgggggmgaagttctcagcctcctcctcctgaccagtgcttaggtccatgagcagttccgggtcatcaaggtcatcaggctccggcaggcgatagctgtctgaggtggccgagaggagctcctcctccaggctggagtcctcagagctgctggactgtctggaccccacggcctgatgctcctcccaggctctgccaggcctgacctccttgaaaccttcaggctgggatgctgtaaggacaggcaaagttgagcaa

SEQ ID NO: 410 - DNA, 601 bp, Homo sapiens
  misc_feature (301)..(301): R = A/G
atagacatagcgctcatttgtatttgggaactggaatgtcttcttcaaaaaggtagaatttaagctgcagagttttaaatttcttttaagaaagggagatgagaaaaaagatcattttagtggaagtaaatggtataaaggtgaaattaaagggtctttttggggatttgaggtgtttttaaagtgtttgtactaaaactcaggacaacttagatatttttccatctatacctaatgactgttttgtaacatgaagatcggaagcatctctactcatttattttactttttccagcaagcrgcgtttttcagaggaaaacagtaaaacagatcaaaatttgggaaaagctgaagaaaaaactaaagttaaaagagaaattgtggtgagaatcagtttgatcaatctagttacaacttgtgtgtgtgtgggggggtgcgtgtgtgagagagtgcatattacatagtatgcactttcaatattgtttaatattttccacactactagtaggtttgctggaaactaatttctagttattattttgtgaaacttagattaaaaaattatggcattacaatttctagctgtatatggaggcaatta

SEQ ID NO: 411 - DNA, 601 bp, Homo sapiens
  misc_feature (301)..(301): Y = C/T
tggtagaaagtcaagaagggaagagagcattggtacctttgatgctagatcacgtttacatttcaagtggcagatgctctgggcctggtcacccaagtcaatgccttttaaaccaaaatccctccataaagctgtcaaatatgtctcttaactgaaaagcaactttcaggaaataataagtgggcccacattactaagtaaatgcaaagcaccctgagaccctacccccactgcatggctactgaatgctcaccacaatctattcttgctttccaggggagatggatcctatcttactaaycatcagcattttgagttttttctctgtcgctctgttggtcatcttggcctgtgtgttatggaaaaaaaggtgaccttcttcaactaataaagagggtgattgtgtgggatcacggacagtcagagcttaagccccatttattgatgagaaaaccacaaaggggattaaggcatttcacgaatttagtgcccagtatccctatctatcctcagcgaatttccacagttaatttcataagaggcaaaaagatattaactggacattaggcaaacgctgtccccaaagtaagaattccgtaat

SEQ ID NO: 412 - DNA, 801 bp, Homo sapiens
  misc_feature (401)..(401): R = A/G
gctgcttgtaggaaaggcccataagggaggcaggagggacgggagcaggggatgagggcagaggacaccctacaaatggatcagagaactgcagatagaaaggggtagcagggagcagggagggcaacaggacccagggggccatgagaaaggaagctgaggaagtaggagggaacttggtgtccttagatcattggagtccacagtagctgggagggttgacagagaggaaagaaccctgggaacgggaggcgaagggataatgagctggggatgggagcagtcgcaggaagaatcctctgcctggagccggcaggctccaacccctcagcttgagagtcaggagccccatagtccccacagcaataggaagcaccagctcctggtcccgaaaaaaggarggccccaactccagggactgcggcccgccctggagctgagaacacgcggactccagggagaggacagggcttcagggacccgagagccgctctgagcaccgggggatgtgactgcctcagcggcagagctggaagggccctcgaatgccattcacaggaacagcccaggaacccagggacttcagaagggctggtttgtccgaaaagtgagaggaggcggaggagaggtgaggagagcaagtgcaagaagagaccagaaagtgcagggggtgggggtgatgcgcgatcccgaggaggactgaaaagagactgaaaagcagggctgaggagtggcggcaaccggcagcgtccagctcccgcacctcgctgcacatcgcacctgagccccgccgcgaccgca

SEQ ID NO: 413 - DNA, 801 bp, Homo sapiens
  misc_feature (401)..(401): S = C/G
aatttcaatgagaataatgaatctagcacagtacctgacacattttagaaaataagtatttgcttaataaatgaatggtgatgggaatcgtcctccacaaagccgaacaacatctattattgtgcatgggtggggttgcctcttaaaagttattatttattgcccacactggaagaaaaaaaaaaaaaacagccgagcccaaaccctagtttgtgcaagtggcgttaggaacttaatccaaacccgaagaaggaagactcctgcgaatcccacacccaacatccatctacagtgagaaaggcgctgttggcctccagtgcccgccccccaccccgcccccctccgcgcccccaatgctccgcagtcttccacctccgttggagcactcacgtctctggcgstgggtgcaggtgaggcccgggacgaggagggaagagcagcctcgacagagagtcctcttcaccgagggatccctgggggcggaggaggatagtggtctggcgcccgcgctccctctcgcgttcctcccgcgtcccgcccgccgcccgccccgtggctgtctcaccgccgcaagacgagccgcttcgcaatggtcctctcagtgtagcagtaaaacctcgccagcgcctggttctcggggtcctgggcaaggacacaatgggcggcctgcgggaggggagcagtcactctgggacgccgagcaccgtccccgtggggcccttgtcgcagactcacctggtacaggaagttgagcctctggaaggcctcgcggtccttcaccggccccgccatcaccgccgc

SEQ ID NO: 414 - DNA, 601 bp, Homo sapiens
  misc_feature (301)..(301): W = A/T
gttgttcccattttcctgatgaaccaaccgaggcctagaaaaattaaggccccacgtttgtggcatgagttcactatggagtgccctgtgcatgtaggaaatcgaatccttctccatttcttgggggttttacttctttctggaatccttgcatttattcttacgatgtccggtcggttttctgagcattttttgcagctctggaggtgagtggggcgcgtgcgttggctctcgcagctctgcagctcacgcaagggcgtttctacccttcttcccacagaaggacttactcctcagtgawattccaagcagcaccgcctcgctctgctccaggaagacgggcgtggagaacgtgatggcaaaggagatctgccagaagtacctggagaagggcgcagggaggcttccggaggactgcgccgaggccctggccacggctgcctgcctgtgcctgcggaggcgtaacaccagcctgcaggaggtgagcctcgcccgcagcggcctcgctgcctgggccacgcgtgggtccacctcatcggggacggccccttcgcagaggcctggtgcacaaaccagggttgtgcttgcttgcaagccgcag

SEQ ID NO: 415 - DNA, 601 bp, Homo sapiens
  misc_feature (301)..(301): S = C/G
tctccagcaactggaagaatcacccctattaaaaagaggtagctcaaaagtaggaaaaagttcttgttggtctgcccttacagtgaacacacataactctgtatcgcccaccaagattacagacctttaacaggccaaaggtccctgggcttagccaaaccaactgaatcacaacagccttgatatcatcatgtggctgacaaaatgtaggaaaaacaaacaaacagacaaacaaacaaacgataacaaacaccttccatcccctaccccctgacccataaacaccttttatcaggaattscagagtatcttctttgaggccaggatctatacttcgaaagtgactatgagggaaagaaagtgtgggggtgagacaggaaggagcctgcagagccccttctaacagatcagatctaacccgtggaatcgaatgtttaaaaatacacgtgaaattgttcaactgaataaatacggtggcaagctgggtacatgctcatcagagatatcaatatccagaggcatttatcagtgaacctataacttggaatttcaggactaacatgcacagttaggacaaacagtcaccagttctttttaaagt

SEQ ID NO: 416 - DNA, 1114 bp, Homo sapiens
  misc_feature (201)..(201): S = C/G
cacggtatagcattgagcagaatgaatttgaggagtttcagagtttttaatgaaaattttagctttctacctatgatataacttgaaataaactgattcttaatagatatgccagattttttttgaataattctaattgttaccctagatattgaaacccccaaggagtcctcttcaggacctcagaggtgggaatgaaasagttcaggtaagtcttttgtgcaaatactttatagatgactattttcagttatatttttaagtcaagaagtttattagctatttgaagaggaaatgtgtaagcatcccatgagtttccaaacacttgaatatactggcattcttgatttttcatttttcttcttttttctaggaatggcatctccctctcttacccaggttggagtgtagtggcacaatcataagtccctgcagccttgcattcctgggctcaatcaatcttcccgcctcagcctcctgagtagctgggactacggcacatgccatcatacttagctatttatttatttatttagaaacagggtctgactgttgcccagactggagtacaatggtgcgatcatggctcactgcaacctcctccccctgggctcaagagatcctcccaccttagcctcctgagtaactaggcctacaggaacatgccaccatgcccggctaattttttattttttatagagacaggatttcgccatgttgccccacgctggtcttgaactcctgggctcaagtaatccacccaccttggtcttccaaagtgctggcattacaggcgtgagccactgtacccagcccttaaaaaatttttgtttttagtatagacagggtcttgctatgttggctgggctggttttgaacttctgggctcaagtgatcctcttgcctgggcctcccaaagtgtgggtattataggcatgagccatcgtgctgggcctttcttttttcatgtcagatgtataatgtgccaacatcgtaacaaagtttgaagaaagcacatctcacacatgcgtgtgaaaacccaatcacacttatgaactacgaaaagatcagtattcttttttttcagtaagaaatatattagtctctgttagtc

SEQ ID NO: 417 - DNA, 701 bp, Homo sapiens
  misc_feature (501)..(501): Y = C/T
ttttcctttcttactttttttttttctttttgagacagagtctggctctatcgcccaggctggagtgcagtaccacgatctccgctcactgcagcctccgcctcccggattcaaacgattctcctgcctcagcctcccgagtagctgggattacaggcgcctgccaccacacctggctaattttttgtgtgttagtagagacggggtttcgccgtgttggccaggcttgtcttgaactcctgacctcaagtgatccgcccacctcagcatcccaaagtgctgtgattacagccgtgagctgccctgcccggccccaaattcctattttctcatttctcagtgggaaaactcaaggatgagagacagccaacacgggctgggagtcctagagcaagacctggtggagaggcccctggggaggcacagaaggcggaagagttggagtggtgagattcctgggcacaatacctgctgttccagcttctgcagcctcatagcagygagctcatgccccaggatgctgagagagacacaggcccatggtgacagtgcacagggaacctcggttgcccaagagagtccctccttcccccatcctgcccctatctcagcttgggttctgggcacctgtgaggtcacaggaggtgcagaacctgagcctgctccaccagttatagggccctttctcctggcactggccc

SEQ ID NO: 418 - DNA, 601 bp, Homo sapiens
  misc_feature (301)..(301): K = G/T
cagtcaatgataagtattaaattgaggaagcagaaaaagtaaacagaaataaacaactttcagaatatatttggaatgtttaactgtatgcattttttattttctttatttttgattcttaaaattttttccaagaaatagaaatacttgaatctcaaattgaacagtgcattataaaagactgattgcattgtttcatttacaagtccattaattcacaagcaagtgcatttgatggaagaaggcatcttatgtgttctttggtgtacatgtgtttggattaagaaacacttcctctctktctttaagtacaatattatacctgcaaagtggtggtctgagaaagagaaaaatggagagaacaaaaaaataactattagtaaaacaacagagttgatttccttctctcattaatattagaatagtccatgcctgtaactagctagttctctaaatgtagggagttggaacaaatatatgggatcatttccattctatctcatttggctgtgtagggatgaaatagacataatgcttataagaaagaaaaaaatctgtttcaacttcttttctcactgctttattggaaaacttaattgta

SEQ ID NO: 419 - DNA, 548 bp, Homo sapiens
  misc_feature (514)..(514): R = A/G
caaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggtgaggctcctgaccctgtcctctctgagctcagtggctccgttcatgccctgctgccaggagagctctgggcagggatggagggagaggggctcagccagtgggggactcagccctcagaggggaggaggacaacaggggccctcccaggcatgcccatgctcttctccctcacctagggtccagaaggtgccaggtggacagagaaatggtccttgggaagctgcagggcagatatagggagaggttcaatttgatgtggagacccaagggcaaccccagactctcaccctcctcttgtccttctacccaggatccttggaggrtcccaggccctcacccacaaggtccgtctcaaca

SEQ ID NO: 420 - DNA, 729 bp, Homo sapiens
  misc_feature (334)..(334): R = A/G
tgtcatctcctccaggaagcctcttcttttttttttttaaattttattattattatactttaagttttagggtacatgtgcacaacatgcagatttgttacatatgtatacatgtgccatgttggtgtgatgcacagaagccttttctgacctgcctgttttctatacactgctacacattatagaaaccttcaagccccagctcaagcgccaacaagcaataacaacctaatgggcacttcctaatgccagactgggcaacagaggttttttaaaaagtgaaaaacaaatgttcctgccctcaagaggaacacacagcagtggcagggacagrcagctaaacccatgatcatgatagagtgagatcaatgctggaattgaagtattatgtagaggagcagaagccagtggttcagcctgtggaagtcagaaagggcttctcagaagacgaaaagcctgaacttattattgacaacagagaaaagggtggatattcagacaagaagaataacatgggctaaagttggaaacggcatgaagagttcattatggtcacaggacaaagcttgtctggggatgagcagaaggtgcaagcggatgctcttagcagcaagggccaatgaaacataaggagcaaactggtatgactgagttcacatttgggggaaatttaggggatggggaggatgggttcaggagaaatgtacccagagacttggaagaagactt

SEQ ID NO: 421 - DNA, 1706 bp, Homo sapiens
  misc_feature (692)..(692): R = A/G
ttctgttttttcctctcaggaaaaactgaagcctcagtacttggaagagctacctggacaactgaaacaattctccatgtttctggggaaattctcatggtttgccggggaaaaggtaggaagaagggaaaagaagaggatacttctctatctctgcaggctactactcctcagacctaagcatcttattgcttttcttctagctcacctttgtggattttctcacctatgatatcttggatcagaaccgtatatttgaccccaagtgcctggatgagttcccaaacctgaaggctttcatgtgccgttttgaggtgacgtttcctgcacctttctcttataaaaacactcacaggctcccctgggacctgcaggatcccatagtggaggattcttccccggcttttgcctaatgggatcaatggttggacacctctagacctttaagtcttgggaagagcctaacttctataccttggaggcactgtctacaaaaaaatggaggaggtagacgcaggcaacacgtgaatgttgctgttctggtatgcatctgttggactgggttggggtcgttataagatttggtgtattttcctttcaggctttggagaaaatcgctgcctacttacagtctgatcagttctgcaagatgcccatcaacaacaagatggcccagtggggcaacaagcctrtatgctgagcaggaggcagacttgcagagcttgttttgtttcatcctgtccgtaaggggtcagcgctcttgctttgctcttttcaatgaatagcacttatgttactggtgtccagctgagtttctcttgggtataaaggctaaaagggaaaaaggatatgtggagaatcatcaagatatgaattgaatcgctgcgatactggcatttccctactccccaactgagttcaagggctgtaggttcatgcccaagccctgagagtgggtactagaaaaaacgagattgcacagttggagagagcaggtgtgttaaatgggactggagtccctgtgaagactgggtgaggataacacaagtaaaactgtggtactgatggacttaaccggagttcggaaaccgtcctgtgtacacatgggagtttagtgtgataaaggcagtatttcagactggtgggctagccaatagagttgggacaattgcttactcattaaaaataatagagccccacttgacactattcactaaaattaatctggaatttaaggcccaacattaaacacaaagctgttgaaatattgatgaaaatgtaagaatttttgtgaccacggggtaggagaagtttctttaaagacgtaaaaagaaaaaaaccataggctgctctgcctgtggagtagccattctttattcttttactttttaaaataataacaatcacaaaggaaagatttgccaattgaataggatcaaattctacaacttttcctaaggcacccacaaataaatgacaagtgagacaaaaagcactagtataaagattatataaagacctataaatcattaagacaactgagtttttaaaaatggacaaaatccatgaacaatttataaaatagaaatatagccaaaaatgtctaaaagatgtttatgatgtaaggaattatcaattacaacagtgagaaaccatatttccttctatccgatgagtaaaaagtttctaaagtgttggcaaggctt

SEQ ID NO: 422 - DNA, 801 bp, Homo sapiens
  misc_feature (401)..(401): Y = C/T
tttcctacccagtggggaggagctgcaccttccatttctccattccggttaccactcgcttccgatgacaggccccagctgagagcgcatctcaggtggatgtgtgtatactttccccctaacttcctgtctttgccgtagattaccgtaagaagtacagaaagtacgtgagaagcagattccagtgcattgaagacaggaatgcccgtctgggtgagagtgtgagcctcaacaaacgctacacacgactgcgtctcatcaaggagcaccggagccagcaggagagggagcaggagcttctggccatcggcaagaccaagacgtgtgagagccccgtgagtcccattaagatggagttgctgtttgaccccgatgatgagcattctgagcctgtgcacacygtggtgttccagggggcggcagggattgggaaaacaatcctggccaggaagatgatgttggactgggcgtcggggacactctaccaagacaggtttgactatctgttctatatccactgtcgagaggtgagccttgtgacacagaggagcctgggggacctgatcatgagctgctgccccgacccaaacccacccatccacaagatcgtgagaaaaccctccagaatcctcttcctcatggacggcttcgatgagctgcaaggtgcctttgacgagcacataggaccgctctgcactgactggcagaaggccgagcggggagacattctcctgagcagcctcatcagaaagaagctgcttcccgaggcctctctgctcatcaccacgagacctgtggccc

SEQ ID NO: 423 - DNA, 801 bp, Homo sapiens
  misc_feature (401)..(401): Y = C/T
ccattcagaggcctggaggatcctatttgaatgagattgtgagagatgggcactaccatcagtttacaggcaaaatggagatttcacaaatgctcctggagaccatgggccccgacctccacagtggcagccccaagcatgagcctgtcctggaaggaggctggctatcgtccaagagtcagagggtcaggcatcaggtgatgactgtggacatgaagaaatggtgacatgttcaggagctggcaggcccgaagatgcactgggtagacccagtgggggcctggacaggttggaggaaggagagagaggaggctgaggtgagcctgaagtgaggtgtcccagggatgaacaggtcagagcttctgagggggctgaagaagcaattcactgactcctttctycaactggggataaataacctctaatttctgtggagcactcctagaaacaaagaaatctttcatagattaatatgtattcatatattccattggctcttccattggccatgtagcatcaagatacaaaagctaacggagcagtgggtctccttgacctctgtgcatgtctgtgttgtgtgggtttatatgcacatgtgggaaagaagaagggacagctcgtacctgttcagtaagtcaccagcattctaggagagagaaaaagtgagaatcataattggttctcaggttcctatcacctccaaattcctttcccaattcactcttggaggccactctggggtgccaccttgagaactgggggaacatagcaacacccctcttctgtgcccattctgctgca

SEQ ID NO: 424 - DNA, 801 bp, Homo sapiens
  misc_feature (401)..(401): R = A/G
atgcacatgtgggaaagaagaagggacagctcgtacctgttcagtaagtcaccagcattctaggagagagaaaaagtgagaatcataattggttctcaggttcctatcacctccaaattcctttcccaattcactcttggaggccactctggggtgccaccttgagaactgggggaacatagcaacacccctcttctgtgcccattctgctgcagcagcactctgtagcctggaacaagccacatctaccacaagtcaccacatatcacacaggcccctccctcttacacctcccagaagggtgatgcagatgggctgcctcctatcggggagaatcccagcccttggggaaggcctcagggtatgcaccttcagtgtgttggtgtctaattccttggccrtcctttccagatcaatgaccaggcttctgagctgtgttactgccctggagatgtcaaggattctggccgcttctgctggcatgtgctccagctggcccagccactgctgagggagggcacccagctgttccctggtttggtgctggctctccggcccagcctccagcctgtggttcccgtggtctacctgaaactacaggaaaggggctccctaagactcagtgtcaggtggctccctcctggcccttcacagtctctgaatgtctgagcaggaatgctgattcctcagtcctcttgccctcatggtgttgcctctgtgtgtcacaggtatagcagaagcagctttgattctcataaaggcagggacacctcacctttccacctcactctctgaatatct

SEQ ID NO: 425 - DNA, 1153 bp, Homo sapiens
  misc_feature (218)..(218): Y = C/T
gataaaagatggaagctgttactgtgctcaccaaggaatgagcatctgagccagtgactgaggaggtggcacctgacctggcttcagatgtacatgggtaggaactggctactcacattagatcaggaagacaaacttctcattggaccttttgtcttttcagccaaacctcaccgcaagacaccttttagagaagaacaaaggtcgccagtcatccygcacaaaaaacctgtccctggtgtcctcgtcctccagaggcaacacgtctaccctccgtaggggcccagggtccaggaggaaggtgcctgggcagttttccatcacaacagccttgaacactctcaaccggatggtccattctccttcagggcgccatatggtagagatcagcaccccagtgctcatcagctccagcaacccctctgtgatcacccagcccatggagaaagcagacgttccttccagctgtgtgggacaggtagggaagaaacgcctgggatgagggcactttggagttgggcaagtgattcataccatgtcacaaccaatatttgatgtttagtacttgctaagcacccagaatgccctactagtaactaatgccatatgtattccatgttagaattgtataaaccttttatttcatccttgaacagcctgtgagttaggtgttattactattatccccattttacagttgagcgaacttaggtttagaggggttaaacaacttatccaaattctcacagatacttttctttcccttgctgagtgccatgatatcgttcctgtcccttagagaacttccctctaaggagatgatggcacctattttctcgagagtgttttggcatcacaatctgagattcaatatcccatcctctggcaatgtattagacatcagatggaaagaaagcaaaagaaacaaaaagaaactatgggttattgaatgttctcaggactggttacctacatttataggacccagtccaaaatgaaaatacaagtcctatgctcaaaaatgatcaagaatttgaagatgggaacagcagagcattaaaccaagcaaagagccctgtgtggctatgcaaggcacaaaccggtgaagccagccctgggtgtttccagatggagtacctaataagataatgca

SEQ ID NO: 426 - DNA, 1019 bp, Homo sapiens
  misc_feature (514)..(514): Y = C/T
caatatgataagtgttcacaaaaagtaggtcaatgccagtgtatcacttactttagtcactagcagcaaactatgtaatttttacttagttctgtggcttagtaacgttaagccggaggatatatgtgggatcattttaacaagggattagttttaaaagcatttgacttgttgttatttagttccttctgtgttatatttgcatcatcaccactcagcacatgatttattgtccttttaaactatcttaccaaagattttttaacaacttgtaattttctgcaattcacctagatttgaaaatgtgatattaaataacttagtggtaacttttagcttaagtcttattttcttttagcacccatcattagctgtatatgccattaaatgtttgcttttcttctttgtcttccagtaattatttaattagggaaagtggtaactaaccatgctgaattctctttcttaaatttctgtttttaaaagcttgcaatctgagggaaaatcaggtggyaaagccttgtaatgagctgcaagatcttagtgagagtgaatgtttgagacacaaatgctgtttttcatcatcggggaccacgagcttcaaatgttttgctccatttagagatggtaagttattcctctttcatttatttctattttttaatattaaataaacagatcgcagtggcataagttcatatttggatttcctagcttaatacttaaatgggactcccagtcctagagcggtgctccttagaaggtcctgaggtggtcatgactctggtcaggagcagtttttgcttagcctttggatggtgactttggtaatacaaaaattagtctcacattttcttttgctttagtcactctctgtgttttgtccaaaagtttccaggctctatggaaccctcaatggctgagagaagataccggttgggcatgccttagcttacttctctttgcccagcttttcctcctaggtagaattcttcccatttgtcttgtcttcatctcag

SEQ ID NO: 427 - DNA, 601 bp, Homo sapiens
  misc_feature (301)..(301): W = A/T
gttgtctttctttgtctttcatttcatgttttgtttggtcgaggaaggacagtgtgtatcttggaactctggaatggaattttaaatctgtaatatttttgccagtgatgggaatttctttattgtttttctcatttttctttcccctgtgcatttcactcttagataactttttacattttctacaaaaatgcacatggaattttgacacagtttccctgaaggggagtaatttcttcactaatgcctctaattctgaaattctctttgattttatatcttcatttaagttaccgtccawgttttcttccttaataaagttcattttatcctggtgaataggggacatgtcatatttaccattcctgtgaacatctggatcagtttgtaaagtctgaagttcatttgtaagtgccacttcccccatcatgtgacttttgaagctcttctttcatttgtttgatagaatggcaaatgtcatctaaattttcacaaaatccatgcttgagaaaaggcacagtaattttggatttatccagaattactgtatcagcttgagacatcacatttggaggtgcagtaggtagaaaacgataaaagt

SEQ ID NO: 428 - DNA, 501 bp, Homo sapiens
  misc_feature (251)..(251): K = G/T
gttcattttatcctggtgaataggggacatgtcatatttaccattcctgtgaacatctggatcagtttgtaaagtctgaagttcatttgtaagtgccacttccccatcatgtgacttttgaagctcttctttcatttgtttgatagaatggcaaatgtcatctaaattttcacaaaatccatgcttgagaaaaggcacagtaattttggatttatccagaattactgtatcagcttgagacatcacatttkgaggtgcagtaggtagaaaacgataaaagttattataattcttcaagatgtcagaattttctgaagggtgtataattatgtttgaagataaattgtctgttgaagttctcagagttaatgtgtcctcggaatgtatctgggatggaacatttacactttgagggagactgttcacactatcaccacttaatttttcttccactgaatgaagtgtcttggaatcctcaaaatgatgacttttctccataga

SEQ ID NO: 429 - DNA, 801 bp, Homo sapiens
  misc_feature (401)..(401): Y = C/T
caaatatccatattaaccactatttttcaaggaagtatggaaaagtacactctgtcactttgtcactcgatgtcattccaaagttattgcctactaagtaatgactgtcatgaaagcagcattgaaataatttgtttaaagggggcactcttttaaacgggaagaaaatttccgcttcctggtcttatcatggacaatttgggctagaggcaggaaggaagtgggatgacctcaggaggtcaccttttcttgattccagaaacatatgggctgataaacccggggtgacctcatgaaatgagttgcagcagaagtttatttttttcagaacaagtgatgtttgatggacctctgaatctctttagggagacacagatggctgggatccctcccctgtaccyttctcactgccaggagaactacgtgtgaaggtattcaaggcagggagtatacattgctgtttcctgttgggcaatgctccttgaccacattttgggaagagtggatgttatcattgagaaaacaatgtgtctggaattaatggggttcttataaagaaggttcccagaaaagaatgttcatccagcctcctcagaaacagaacattcaagaaaaggacaatcaggatgtcatcagggaaatgaaaataaaaaccacaatgagatatcaccttataccaggtagaatggctactataaaaaaatgaagtgtcatcaaggatatagagaaattggaacccttcttcactgctggagggaatggaaaatggtgtagccgttatgaaaaacagtacggaggttt

SEQ ID NO: 430 - DNA, 1315 bp, Homo sapiens
  misc_feature (876)..(876): S = C/G
aggtattcaaggcagggagtatacattgctgtttcctgttgggcaatgctccttgaccacattttgggaagagtggatgttatcattgagaaaacaatgtgtctggaattaatggggttcttataaagaaggttcccagaaaagaatgttcatccagcctcctcagaaacagaacattcaagaaaaggacaatcaggatgtcatcagggaaatgaaaataaaaaccacaatgagatatcaccttataccaggtagaatggctactataaaaaaatgaagtgtcatcaaggatatagagaaattggaacccttcttcactgctggagggaatggaaaatggtgtagccgttatgaaaaacagtacggaggtttctcaaaaattaaaaatagaactgctatatgatccagcaatctcacttctgtatatatacccaaaataattgaaatcagaatttcaagaaaatatttacactcccatgttcattgtggcactcttcacaatcactgtttccaaagttatggaaacaacccaaatttccattgaaaaataaatggacaaagaaaatgtgcatatacgtacaatgggatattattcagcctaaaaaaagggggaatcctgttatttatgacaacatgaataaacccggaggccattatgctatgtaaaatgagcaagtaacagaaagacaaatactgcctgatttcatttatatgaggttctaaaatagtcaaactcatagaagcagagaatagaacagtggttcctagggaaaaggaggaagggagaaatgaggaaatagggagttgtctaattggtataaaattatagtatgcaagatgaattagctctaaagatcagctgtatagcagagttcstataatgaacaatactgtattatgcacttaacattttgttaagagggtacctctcatgttaagtgttcttaccatatacatatacacaaggaagcttttggaggtgatggatatatttattaccttgattgtggtgatggtttgacaggtatgtgactatgtctaaactcatcaaattgtatacattaaatatatgcagttttataatatcaattatgtctgaatgaagctataaaaaagaaaagacaacaaaattcagttgtcaaaactggaaatatgaccacagtcagaagtgtttgttactgagtgtttcagagtgtgtttggtttgagcaggtctagggtgattgaacatccctgggtgtgtttccatgtctcatgtactagtgaaagtagatgtgtgcatttgtgcacatatccctatgtatccctatcagggc

SEQ ID NO: 431 - DNA, 601 bp, Homo sapiens
  misc_feature (301)..(301): R = A/G
ttaggacaatgagtttaacggtgatgtgtcccagacgggggtagggagagtgaggagatgcgattgtggctgccacaataacacttgtgcgagttaggtggggctgtacatatggttcttcaatcagcatttttcctctaaaaaccttaagcaatcctggctatgcagggagatgtctggcggttgcgtaactcacacccagcagccatagagactgtcccttgttgatccttcagggcggaataatgggcattgagatctactgggactgcaacctagaccgttggttccatcactgccrtcccaaatacagtttccgtcgccttgacgacaagaccaccaacgtgtccttgtaccctggctacaacttcaggtaactccaaggcccaggtcaaactcacccagtggctgaatcgcattcccaggaactggtgagactaattttggtttccaaggcaacaagatgaatgaaaaaagactttctctaagaactaggtgataactgaattttttccataattttttaaaattctcaaaagagatgcacactctttattttttacttatttttttttttttgaaatggagtctcactctgtca

SEQ ID NO: 432 - DNA, 601 bp, Homo sapiens
  misc_feature (301)..(301): W = A/T
cagtggatgggtaggcagggaataaacaataaagagagtgacattgttttagctttctgtgactccaaccaccggttggttggatggatggttaacattagctagaaatgtttaggatagtaattttaaaccttagtccacttaccagtagcctaagcaatataaatggctgcagatccttgtagaggtgttgccctgcaccttggctctgtctgaaggccagtgacgcagtgacagggaatgcagagacgtggaagggctgtttccagagacagagtagagtggtggatccagacaccawcagatgccagagaaacacttgggccttttcttggtaccagttaacaggtgccctgctgggaacataaacacaatcttctggacttccaaaccaaacataacagagatagggcggcagaggatgaacttggacagccccaagcaggcatgccctggcttccttagacttcctctgtgactgtcaaatggattaaaatatgtgatatgttctcttcctgcaggaagttcaacttgggaaatggaccagggtcccagtaaggagctgggcttctctgtggatgctgtatggcctgatccccca

SEQ ID NO: 433 - DNA, 601 bp, Homo sapiens
  misc_feature (301)..(301): Y = C/T
cattgcactcataaggtttctctcctgtgtgaattctctgatgggtaatgaggccatatttgtgtgaataggattttccgcactcggtacatacaaagggagtctttcctgtatgacatctctcatgttgtatgaggcatattttctggctgaaggctttaccacattcattgcattcatagggtttttctcctgtatgagttcgctgatgtataataagagtgcgctttgtggtgaagcctttaccacattcattgcatatgtaagatttctctcctgtatgagttcgctgatgtataaygagagtgcgtttgacagtgaagccttttccacattcgctgcatatgtaagatttttctcctgtgtgggagcgctgatgtacaatgagattgctcttcacggtaaagccttttccacattcactgcacatatagggtttctctccagtatgagttcgctgatgtacaacaagatagcgcttcatggtgaagccttttccacattcactgcatatatagggtttctcccctgtatgagttcgctgatgtacaatgagattgctcttcacagtgaaaccttttccacattctttgcacacata

SEQ ID NO: 434 - DNA, 704 bp, Homo sapiens
  misc_feature (504)..(504): S = C/G
tcagaaggaaccatagagttcaaatgacagggtgttgtccatcatgataaagactttgcctctatctctaaggcaacttattttcccaaagaactctctcatctgcagagagtttcccactttatttatttatttattttgagacggagttttgttctgtccacccaggctggagtgcagtggcatgatcttggctcactgcaacctccacctcccgggttcaagcaattctcttgcctcagcctcctgagtagctgggactacaggcacacgccaccatgcccggctaatttttttttgtatttttagtagagatagggtttcacaatgttggtcaggctggtctcgaactcctgacctcaagtgatctgcccaccttggcctccctaagtgttgagattacaggcgtgagctactgtgccccctcccacactctagttaatgagtggccttctctctgcccatctgagctcttacctgtgaccacgcctttgacacattccsgcgttcttggttttcttgctattttcacacagctcttcacagtccagggctctttcccttcctccaacatggagataatattcatatcaaaatgacacagtcctgtttataaaaagaaaggatcacaatgtgccggggcttttccagaatcccagccctatgtttacatgagaggacattatatgtggatctaagaaaac

SEQ ID NO: 435 - DNA, 601 bp, Homo sapiens
  misc_feature (301)..(301): R = A/G
ctcggcctcccaaagtgctgggattacaagtgtgagccaccacgcctggcttgcattttttttttctacttggcagcaaatgctgatggaattcagtgctgactacttaaagttgagtcacatcacacatttaatcagggtaataagaacatagcacacccactgtagagttacattaagacataaaaactctttgcttgaaatcaataaccgcgctgcacatgggacatctgtcaactgcttcagcacattgtttacaagtgaccagatgtccacaaggaataaaaacaacagcgatatrtctgtccatgcagattttacaaagcttctcctcttgcagacgccttagcggctcttcagggctgatttctctctgcaatgaagtctgattcaattcattttctgtagtgtctttctgagcgctcactagatctgcaacaagaacctcaagcgttttatagttgctcccagatgtttgaattctttcctccattattttcttaacgtccttgaaatcaaatcccattcgtatagcttcttgtagcataggattagggaagatggtatcactgattcttttagttagtgatggtgttttctt

SEQ ID NO: 436 - DNA, 601 bp, Homo sapiens
  misc_feature (301)..(301): Y = C/T
tgtgcccagccccaggctggtcttgacctagctcagaaaggagtgggattttgcctgggaggtgggggcttactcccaaagctgttgggctggcttactgcacctgcaggctgtcagaggtctccaggtagaggtagtagagggggaacaagcccttgtccacgccgtgcttgtcacgggtgaggtagcactgcatcatggtgcccgggagcgctggccgcagcacgtaggcttccatgtcctcctccagcccagggcagggggagcggattgccaaggaggcttcgtgcctcatatggtygctgtccgtgccaccctcgcctttcagggccttggacaactcttcgttgtgtgctgctgaggagttcgtccctgtagactcagaggcctctctcttcttttccaagtcttcttcctagcccaggcaccaaatttaaagtcgagggacaaccaccggcccagccttgcttactactgattgaccatcccagccctagggtcccgcccttgcccatccacattttctgcttattggtcaaaaatctcattcagtccacccagtcacgccctcctctgttgactggccagtctattcgctttc

SEQ ID NO: 437 - DNA, 601 bp, Homo sapiens
  misc_feature (301)..(301): R = A/G
agaaagatttacagaccaaagtctgctgttcttccctttttcagagcaggaaattgaagccccttcctccaggccactcccaactccaggctatcccaggctcccaaatgcccaggagttctggagccactaagcaggtgcccacccagcagattccatgggtgcccacaagcagacagacttttccttcaggggagatcatcgggggacatgaggccaagccccactcccgcccctacatggcttatcttatgatctgggatcagaagtctctgaagaggtgcggtggcttcctgatacragacgacttcgtgctgacagctgctcactgttggggaaggtgaggagcagaaaacagcccacaccctcctggaaacactccacagagacccctgccttcttcccaaggagctccctgggctcctgtgaacacacatgccaggaggtctccttagagggtgagaaaagggcagttaagtttgtggagagaggggaaggttggttccagaggtgctgctgaagtaagaaacagcagagtgaccaagcctgccatatttagaactgggggcatactttggcataagaatacaaactgaagcaa

SEQ ID NO: 438 - DNA, 787 bp, Homo sapiens
  misc_feature (587)..(587): Y = C/T
aacagccaaacaaaaatgcttatactggcatttgtcaaatctgtgatctgaatcccatggcacaaggtgccattctatttggcttgttgatgagtttttagttcaggctactatagaaatttatcatagattaggtggcttaaacagcagaaatgtttttctcacggtcccggaggctgcatgtccaagatcagggtgtcagtagggtccggttctggagagggctgtcttctaggtgtcagagacgacacagggttgctccctgtgttcttgagtggcagaaagagaaggagagaactctccagagtctcttttataagagccctaatcctattcatgagggctccacccttcttacctcatgacctcccaaaggtcccacctcctagtaccttcacaggggggttaggattttgacctatggattgggggaactccacaaacctttattccataatagtgggagtctatggcactgggctgatagcctcattttggtcttttactcaacagaacagagaggggtctcagggcccacagaagcccatgtggttaaacaaagtcaagacaagtttgaatgagcagaygtacacccgagtagaagggtttgtgcaggacatgcgtctcatctttcataaccacaaggaattttacagggtgagtggctctccctgcttccttttctctttcaattacatcactttaaagtcactttccctgtcatcttttcatgtcaggtaaatgttacaatcgcccttatcatatgacaagcccatacaagtacaaa

SEQ ID NO: 439 - DNA, 801 bp, Homo sapiens
  misc_feature (401)..(401): Y = C/T
gtaaccagtccctttcctcgagacataaattaaaatgtttctctcttgggtcttccagtttggccaccagctcagccaaaacccactcggtcacagctgggtctttagtgtcatacacaataaaagcatcatagcaacagtctggtgatattagacgctgatacccctttatcttggccttacagaaatggtaaatataccacacatcccagaaatagaggtgacttgctgtcatcatcaccatgagaaagagagatacagatatggaaagtgagaacagaatcaggttagtcagatctaactcacaggtgtacagatccagggagatcacactttggcccttgtgtgctcctggccccacacaagtcacatctgtggccaggtaaggaatagtcacctcygtatggttaacccaccagacaaaccacacagcatcacaggtgcacagaaaccgattatgatgcaaaagcaacatcttcagattgttgaggacattttctgggaagctggtcttttggatcatctggattttatttgagctgagatccagatatcgcaactggaaggcatcttgtagaaaatacttcgtcagactcctgatttgattattcttaagaatcagattcttgaggcttctggaacagttggataatctctcagggacagtggtcagttggttgtggctgaggtccaaagtttccaggttctttagacactggagtttcttccaactgaaagatttgagcccatttttggccaaagagagattctttagatttggaggcataccatcaaaaactc

SEQ ID NO: 440 - DNA, 711 bp, Homo sapiens
  misc_feature (155)..(155): M = A/C
tgcctcaaccccatgctctatgtcttcatgggccaggacttccgggagaggctgatccacgcccttcccgccagtctggagagggccctgaccgaggactcaacccaaaccagtgacacagctaccaattctactttaccttctgcagaggtggmgttacaggcaaagtgaggagggagctgggggacactttcgagctcccagctccagcttcgtctcaccttgagttaggctgagccacaggcatttcctgcttattttaggattacccactcatcagaaaaaaaaaaaaagcctttgtgtcccctgatttggggagaataaacagatatgagtttattattgacttcttttttgattttggacctcagcctcgggtggtcagggtgggaaatgataggaagaagctgtcatctgcatcctagtttgcctgaaatgaacccaaataatacccattattattagtcctgaattatgagtagtgaatgatacccatcattctggcatcatgatgagtagtgtccacttccattctgaaaagtgccctgctgtgaaaaataaattatatagtcatcctaggtaaatgaaggaggagggagaagtgtgaaagagtatggcttaaatcagacaagatatacaagaagatactttatatagggcaggagcggtggctcatgcctgtaatcccagcactttgggagcccaaggcag

SEQ ID NO: 441 - DNA, 835 bp, Homo sapiens
  misc_feature (184)..(184): Y = C/T
aagaccctgggtacagtcccttaaactctctggatctcattgcatctgtaaagtctgagagaatgacaaagtgtcctttctagtcctgaccctatgcctcatcctgtactttctccataggtgcccaacgctctgggagagccccaggtgccctcccagcaggccacctcctgctgtttctcayccttggtgtcctttctctgctccttttggtgactggagcctttggctttcacctttggagaagacaggtgagccagggacatggcaaccccgccccccagcagctcccgctcttccatcctcagagtgctgatggcaccccttcctcaggaaggtgaccaaatgggaccctgaacttgccctcagagccccccttcttcataagcctctcactccagggatggcttgtgcctgggtaggctggaaggggggttgggagaaagccaggaccagatggggagggcaggggcgctgagaaaaaatagagggactcagtgtccctcctcatccgcttcccttcatccttctcctccttccgccctccgtctctctctccatctcttctcacagtggcgaccaagacgattttctgccttagagcaagggattcaccctccgcagctcagagcaagatagaggagctggagcaagaaccggagccggagccgagcccggaaccggagcccgagcccgacccgagcccggaacagctttgacctggagctgaggcagccagcagatctcagcagcccagtccaaataaactccctgtcagcagcaagcctgagtctggctttttcttggccagtggagggttcccgtctctccccag

SEQ ID NO: 442 - DNA, 601 bp, Homo sapiens
  misc_feature (301)..(301): R = A/G
caggcatgctggtggtccaggccatctctgccagtctcttcacagcctcacccagctgccccagaccccgggcagcttctaccagctgcgtcagccccagcagcagggcttggcgctcctgccgctcctgttccacgacctgggtcagtctctgcagctgaccacccacatccctcacagcagccaccagctccaccagggcaggtggctcacaagccatgacccttacaggtggtgttggggccacacatggaccatgggggcctgggctctgaccaggagttggccctagggtgagggrgtcaaggggaggatgatccaaggggtgggctgtgggggaaaggagggggtcaggggacacagtaaggtcagaggctgagtgtggggtatgggtgggtggaggggttaggttggggctctggcttctgggtggcttgaagtcctcagtggacagtgggtccatgcttgtggctgtggaggacctggaggggctggactccaaggctggagagggctctaaggtgggtatctgggatgtggaggtgtgaggggcaggtgctgtgaaggtcaactgggggtgcagactgggcttgactgttgg

SEQ ID NO: 443 - DNA, 801 bp, Homo sapiens
  misc_feature (401)..(401): Y = C/T
aggattttataacctgacagcgtgctggaacttctctgctggactcctggactcccacaatggtattgtctcatctgtggatagttgtctaaattgatgcttctgtgtgggaagaaagctcctattctactattttgctgatgcctttctctcatattacttttgttaaataattaggagttggataggagaggaattgcatagctttggggaaaatggtgcctcatagcgtgatggtgaacatttgtgaacatttctcagaatattctgtaactactttgatttcttcttcttttttaaattttggtcagtttttatagccttttatgttgtggcaggaagaagcctgattttcctttaattttacaaaaatctctacatatacttacctcggttatcayatgaagtgtctagagaattgaagaaaaattataagattcttaatttctcataaacagactcctatattaatttcttagcaatacaataatttaccactttgtgttgaatatgcatgtcgggatcctaaaagagaagataaaaacataatgagattttacttcaacaagtgagtctatattattttttgttagatagaaatctgtttacctcttcctcttttagatctctgagaagaaaaatcttttaggaaagaaaaaaacatattaactttaccaacagttcatgaaaaaataagtttatcgggccgggcgtggtggctcacgcctatgttcccagcactttgggaggccgaggcgggtggatcacgaggtcaggagatcgagaccatcctggctaaca

SEQ ID NO: 444 - DNA, 801 bp, Homo sapiens
  misc_feature (401)..(401): R = A/G
ttggtccggccacttcactaaggccatcttcatgaatggatttaggctttttactgaaccatctgttccagtgcctgaactggaacagttctctgttgctgctctcagaccacaggaagcatctgaagggagcctcagaattatgcaggcctacccagtattaattaattctccccaactccagtttggcattcagtactgctcagaaatctctggtagatttctcccactcacttagaagcagttcagttcatgcaatggtgcactatgcaaggttctggaaacacaactgtaaacaagacagatttctttcctgacttgtgaaaattctataagtactatatttatttttctcatgagtataagtacttactttgttctgaactgtatctggagatatrcatttctgtggaagaattaggcaaaatgtttttattagttacttaggagaagtgttcttcctctgatcaaactcttctcactctaagctatgcttcttgcttaccaaggtggtcctcctgatataatgcattgttgttctcacccattttccacatctcccatcagccctgttttacctatcttttcacactacttatgctttgagggctcacaggcattgaggatgggaaacagggagggaatacagctgattagaaagttgtgggagagaaacagaaaaatccaggaaagagagaccttatggcatagaaataggtcttagcttttatgagctccatctctatttcatcgacaagtactactctgtatttgtctcttcttatcatctccccaaattaa

SEQ ID NO: 445 - DNA, 801 bp, Homo sapiens
  misc_feature (401)..(401): S = C/G
gaccacgggaacacgccaccacagctacttttttattttttttgtagagacaggctgaccagtttctttgtacttatttttatgtggctgatagaaaattgaaattctcacctgtggcttccactgtgtttctattggactaaagaacctgtcacattttgtcagctcccaaccaccccctaccactgtccttataaaagaaataaaaataaaacagcggctgcctcttacctgtggcactagtgacaatctccacagagctatttactccgtctttctccacccacacagaacacgtatacaatgacccgggtccaaggccatccacggtgactctggtgtctgttgtgtttcgagtctctgttctgccaccatctccagtgcactgaacgcagtaggtsgagttctgtgggtctgtgccatcggggacctcccagctcagggagatggagctggtggtctgagcctccactctcaggttcctcactgggttgtgagctgagaaattaggaagaaagatctaatatgagcaggactacagaacataacgggggcagccagtgagctttttgtttgtttgttttttcgagacagagtctctgtctgtcatccaggctggagtgcagtggcacgatctcggctcaccacagcctccgccgtccgggttcaagcgattctcctgcctcagcctcccgagtaggtgggactacaggtctgcaccaccacacccggcttatttttatattttttcaccatgctggccaggctggtctcgaactcctgacctcaggtgatcctccc

SEQ ID NO: 446 - DNA, 601 bp, Homo sapiens
  misc_feature (301)..(301): Y = C/T
acggtatgggcagaatttagggcccaatcctaggagttcagtaactgagagatttcagaacttgaattggaattttagagaatcccagaaattagaagtttcttccaaaacgccgtaggctgctaagagccagccatctgctagtgagggccctgttgccctgatcagggtgggcccttcagtggcagagttaggatcaggcccagtactcctggctgtcaaaatgtgagcaaatgttggtgccagctttgacaggtttattcaagcacttgtgtctgtctgtgctcctcctctcccagcygctccttccagggtctgaacgccaggtgcaggctctcctgagcaggtatggccctgggaagctgtaccaggtgacaagcaacatcagtgggactgggactctggacctgactctgcctcggggccaaatcgtggccatccttcaaaacaaggacaccaaaggcaacagcggccgctggctggtggacaccgggggtacgtgagcctttgggagcccttcttctccttcggggaaaaccaccccacagaagccggtgcagagacccgggcactcttgtgggtcaaagtctggctgggcatt

SEQ ID NO: 447 - DNA, 601 bp, Homo sapiens
  misc_feature (301)..(301): N = A/C/G/T
tagaaattggtggcttcatagtccaagggagcagctacagtgagcagccctgtctccagctctatgtcaaagcagccctcctcattgccatctgcaatcacatagaccagtttgccattaaaaccagcatcagggtcagtggctgctaggcgggccaagggggtgttgatagggacactctcaaggacatcaatggattgggggaagtggtcctcaaactgtggggtgtaatgattaatctgatatgtgcttaaagaagtgaattcctcatcactggactcctggttctgaagcccaatanagtggaggatagtctttgtgaattgtgtcaatacccctgttttatcacatgttacaggaacttcaaaatgagggtccttcaccacagtaatattcaaagttgtgggtgaggcatagtttttgccatctgaggctgtaatcttcagggaataactggtgggttgaccagcagtaagattgataaaagggcgtttgagggatatcactccggagaaatgatttagatcaaaatactctagttcattgcctgatacaatctcgtattttaggttctgaagctcatccacatctatggctgaca

SEQ ID NO: 448 - DNA, 601 bp, Homo sapiens
  misc_feature (301)..(301): R = A/G
ggggctggctctttattgtcaactctacgatcccagtataaaaggaaattatgaagatataagctgaaatatatccaagaaatcagatccaagaaaagacaaaaagtctttaaagctataacagcattaaaaaagttatcagatggggagatgaatatatagtggagctgcttaggtaccctcagatacttcatatatgtgacacctttccttaatgactacaataagactcctatagccactgtccttgctggttctcacttacctggacaatttttattctgaattttagcatctgttrtccatggttcttgtccatgtgccaacttggagagtacatctggtttgctagtttgataccctgttcatgaggaaagacaaacacaaacatcctgaattggagtccagtatgtcaagatggaaaaataatacattcgatgaagaaaacaatttcaaagtaagcattctgtcttagaagagattataccactttggggtcagagaggggactgaaaatgtaactcttccaaacaccacagtgactgtaaagctttgattaggtgagcataggacggtgtctgggcattgtaggcacctctag

SEQ ID NO: 449 - DNA, 501 bp, Homo sapiens
  misc_feature (251)..(251): R = A/G
accatgtcacattcattgtgcttgtaaggtttctctccactatgaattacaaggtgtgaattttgaccttttaattacaaggtgtgaattttgaccaacggtcttgccacactcattacacttataatgagtttctctccagtgtgaattctagtatgttttgccagatatgcattatatgcaaaaaccttgtcacaaaccttacctctgtatggtttctcttcaatgtgaattttcttatgtgttttaargtttgatttacaactgaaaacttttgtcacattcctcccatttgtaaggtttctctccagtatgaagtctatggtgatgtgcaaaggttgctttttgattaaaaaccttgccacattcattatgcttgtaaggtttctctccagtatgaattgccttatgacttacagggttgaattgtgatggaaggtcttgccacactcattacactattaaggcttctctccactatgaagcctatgatggtataca

SEQ ID NO: 450 - DNA, 667 bp, Homo sapiens
  misc_feature (565)..(565): R = A/G
ttcctatcagacattacaaattatccacagccttctttcttggctttgtggattagagggagcatccttgtttttgcgcacccaaacagccagaaagaactgtgacaagtattgtagacggaatattcaagcagatggatactgaccaatatttagagcttcccagattttagggctatctaaatttgaagaggatattcttgtgtgatgaattccctttctctggatgtatgaaagaaactcattttgtggagaagaaaaggtttgagtagataacaacctcaaagccttgagattttatgattctaagggtttctggttgtcacaatcatgggcccgacagggttgcccaatttggcaaataataatatatgatacccagttacgatagaatttcagataagtagtgattttgttttactatgagcgtgtcttatgcaatatttggggcatatttatactaaaaagttacattaattacctgaaattcaaatgtaattggtgtcctgtgttttacgtagcaaccacactgcctgtcattgtgctttatgtcagatggtggaaraagcccacgtgacctccaacatctgccagcccagggagattctgacgctgacccccatcctggacattcgtttctacatgctgataatcctgcccttcctga

SEQ ID NO: 451 - DNA, 801 bp, Homo sapiens
  misc_feature (401)..(401): Y = C/T
ccagagcccagatgtccctagtcctcttcaaaagaccccaataaatctgccccaccactaactcctcatgagtctcaagtgttttcttctccattctccagatgccaaatctactctctccggattcccccaactctgaactttcccttccaccaggtctgacctggaaaggtccaagaaggcagctgccggctgtggtcccagcgcccctcccaccaccatgtgggagctcagcacatctgcttcccccagtcccaggaggctgagcctgattgtcctgagaaatgggaaggatcagatatgactcctccttggcaactgccctttcctgccaggcccacacataccctcttctggctgttaggggagcttgggtccctgaacactgtcattcacccaayaaattactatttgaccccagagtgggtggaagggtgagccatgtgttttttttattttaatttttaaaaaatttaaaaaattccctattcaaaggtcaaaaagccacataagttttgatgatgatcaatttgaacggaggctcgagatggactgagaggactgagacacagaagtggggggaccatggtttttactggctggaccacagggggaccctgtccacccgcctgggttgaggaaggtgtctggggtgctcaggtgggtttgttctcagcaatgcaggcatagtcagctcttggatcctccttggtgcctctcttgtctctgcccctgaggtcaggtccctcactgctgggcactggcagcctctgcagagatgcatagtggagttcctgctct

SEQ ID NO: 452 - DNA, 511 bp, Homo sapiens
  misc_feature (256)..(256): N = A/C/G/T
gatgttcagcagcaggctcatttgaagtcggactcaaccctgatggaaactcattctaccttcagaatgtgggggctggggggaaaaatgcaggtcttgggggacggtaaggaagaaaacctctcggtaaatagacatttctcattgcaaatggagcacgtggtggacctgggacatcccttggagaaaaataatctggagaagctccaaacacggttcctggaggaggtggggggaaaggaggtcctcttcttangaacgggccccttgtatctactggaaacaataaacctctgattggagcaagaggtggaggaacaaagccagggccagttgcttcattttcagcggggagagatgaatcaggcacctttaaattaccaagattatctttggtatcatttctactggattccatttctgaaggcattgacccatccattttatccaaagaaggcatattaaaacttctgagttctgctggtccagagagtctagcacaattagaata

SEQ ID NO: 453 - DNA, 31 bp, artificial sequence
  Forward primer
aagcggccgcaatgggatccgaaatcggtac

SEQ ID NO: 454 - DNA, 30 bp, artificial sequence
  Reverse primer
aagcggccgcgccggccagcccggggagcc

SEQ ID NO: 455 - protein, 384 aa, Homo sapiens
MARALVQLWAICMLRVALATVYFQEEFLDGEHWRNRWLQSTNDSRFGHFRLSSGKFYGHKEKDKGLQTTQNGRFYAISARFKPFSNKGKTLVIQYTVKHEQKMDCGGGYIKVFPADIDQKNLNGKSQYYIMFGPDICGFDIKKVHVILHFKNKYHENKKLIRCKVDGFTHLYTLILRPDLSYDVKIDGQSIESGSIEYDWNLTSLKKETSPAESKDWEQTKDNKAQDWEKHFLDASTSKQSDWNGDLDGDWPAPMLQKPPYQDGLKPEGIHKDVWLHRKMKNTDYLTQYDLSEFENIGAIGLELWQVRSGTIFDNFLITDDEEYADNFGKATWGETKGPEREMDAIQAKEEMKKAREEEEEELLSGKINRHEHYFNQFHRRNEL

SEQ ID NO: 456 - protein, 92 aa, Homo sapiens
MQVSTAALAVLLCTMALCNQFSASLAADTPTACCFSYTSRQIPQNFIADYFETSSQCSKPGVIFLTKRSRQVCADPSEEWVQKYVSDLELSA

SEQ ID NO: 457 - protein, 355 aa, Homo sapiens
METPNTTEDYDTTTEFDYGDATPCQKVNERAFGAQLLPPLYSLVFVIGLVGNILVVLVLVQYKRLKNMTSIYLLNLAISDLLFLFTLPFWIDYKLKDDWVFGDAMCKILSGFYYTGLYSEIFFIILLTIDRYLAIVHAVFALRARTVTFGVITSIIIWALAILASMPGLYFSKTQWEFTHHTCSLHFPHESLREWKLFQALKLNLFGLVLPLLVMIICYTGIIKILLRRPNEKKSKAVRLIFVIMIIFFLFWTPYNLTILISVFQDFLFTHECEQSRHLDLAVQVTEVIAYTHCCVNPVIYAFVGERFRKYLRQLFHRRVAVHLVKWLPFLSVDRLERVSSTSPSTGEHELSAGF

SEQ ID NO: 458 - protein, 374 aa, Homo sapiens
MLSTSRSRFIRNTNESGEEVTTFFDYDYGAPCHKFDVKQIGAQLLPPLYSLVFIFGFVGNMLVVLILINCKKLKCLTDIYLLNLAISDLLFLITLPLWAHSAANEWVFGNAMCKLFTGLYHIGYFGGIFFIILLTIDRYLAIVHAVFALKARTVTFGVVTSVITWLVAVFASVPGIIFTKCQKEDSVYVCGPYFPRGWNNFHTIMRNILGLVLPLLIMVICYSGILKTLLRCRNEKKRHRAVRVIFTIMIVYFLFWTPYNIVILLNTFQEFFGLSNCESTSQLDQATQVTETLGMTHCCINPIIYAFVGEKFRSLFHIALGCRIAPLQKPVCGGPGVRPGKNVKVTTQGLLDGRGKGKSIGRAPEASLQDKEGA

SEQ ID NO: 459 - protein, 99 aa, Homo sapiens
MTSKLAVALLAAFLISAALCEGAVLPRSAKELRCQCIKTYSKPFHPKFIKELRVIESGPHCANTEIIVKLSDGRELCLDPKENWVQRVVEKFLKRAENS

SEQ ID NO: 460 - protein, 350 aa, Homo sapiens
MSNITDPQMWDFDDLNFTGMPPADEDYSPCMLETETLNKYVVIIAYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRHLVKFVCLGCWGLSMNLSLPFFLFRQAYHPNNSSPVCYEVLGNDTAKWRMVLRILPHTFGFIVPLFVMLFCYGFTLRTLFKAHMGQKHRAMRVIFAVVLIFLLCWLPYNLVLLADTLMRTQVIQESCERRNNIGRALDATEILGFLHSCLNPIIYAFIGQNFRHGFLKILAMHGLVSKEFLARHRVTSYTSSSVNVSSNL

SEQ ID NO: 461 - protein, 360 aa, Homo sapiens
MEDFNMESDSFEDFWKGEDLSNYSYSSTLPPFLLDAAPCEPESLEINKYFVVIIYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRYLVKFICLSIWGLSLLLALPVLLFRRTVYSSNVSPACYEDMGNNTANWRMLLRILPQSFGFIVPLLIMLFCYGFTLRTLFKAHMGQKHRAMRVIFAVVLIFLLCWLPYNLVLLADTLMRTQVIQETCERRNHIDRALDATEILGILHSCLNPLIYAFIGQKFRHGLLKILAIHGLISKDSLPKDSRPSFVGSSSGHTSTTL

SEQ ID NO: 462 - protein, 468 aa, Homo sapiens
MAPPPARVHLGAFLAVTPNPGSAASGTEAAAATPSKVWGSSAGRIEPRGGGRGALPTSMGQHGPSARARAGRAPGPRPAREASPRLRVHKTFKFVVVGVLLQVVPSSAATIKLHDQSIGTQQWEHSPLGELCPPGSHRSEHPGACNRCTEGVGYTNASNNLFACLPCTACKSDEEERSPCTTTRNTACQCKPGTFRNDNSAEMCRKCSRGCPRGMVKVKDCTPWSDIECVHKESGNGHNIWVILVVTLVVPLLLVAVLIVCCCIGSGCGGDPKCMDRVCFWRLGLLRGPGAEDNAHNEILSNADSLSTFVSEQQMESQEPADLTGVTVQSPGEAQCLLGPAEAEGSQRRRLLVPANGADPTETLMLFFDKFANIVPFDSWDQLMRQLDLTKNEIDVVRAGTAGPGDALYAMLMKWVNKTGRNASIHTLLDALERMEERHAKEKIQDLLVDSGKFIYLEDGTGSAVSLE

SEQ ID NO: 463 - protein, 440 aa, Homo sapiens [sequence omitted]

SEQ ID NO: 464 - protein, 259 aa, Homo sapiens
MARIPKTLKFVVVIVAVLLPVLAYSATTARQEEVPQQTVAPQQQRHSFKGEECPAGSHRSEHTGACNPCTEGVDYTNASNNEPSCFPCTVCKSDQKHKSSCTMTRDTVCQCKEGTFRNENSPEMCRKCSRCPSGEVQVSNCTSWDDIQCVEEFGANATVETPAAEETMNTSPGTPAPAAEETMNTSPGTPAPAAEETMTTSPGTPAPAAEETMTTSPGTPAPAAEETMITSPGTPASSHYLSCTIVGIIVLIVLLIVFV

SEQ ID NO: 465 - protein, 386 aa, Homo sapiens
MGLWGQSVPTASSARAGRYPGARTASGTRPWLLDPKILKFVVFIVAVLLPVRVDSATIPRQDEVPQQTVAPQQQRRSLKEEECPAGSHRSEYTGACNPCTEGVDYTIASNNLPSCLLCTVCKSGQTNKSSCTTTRDTVCQCEKGSFQDKNSPEMCRTCRTGCPRGMVKVSNCTPRSDIKCKNESAASSTGKTPAAEETVTTILGMLASPYHYLIIIVVLVIILAVVVVGFSCRKKFISYLKGICSGGGGGPERVHRVLFRRRSCPSRVPGAEDNARNETLSNRYLQPTQVSEQEIQGQELAELTGVTVESPEEPQRLLEQAEAEGCQRRRLLVPVNDADSADISTLLDASATLEEGHAKETIQDQLVGSEKLFYEEDEAGSATSCL

SEQ ID NO: 466 - protein, 1153 aa, Homo sapiens
MACPWKFLFKTKFHQYAMNGEKDINNNVEKAPCATSSPVTQDDLQYHNLSKQQNESPQPLVETGKKSPESLVKLDATPLSSPRHVRIKNWGSGMTFQDTLHHKAKGILTCRSKSCLGSIMTPKSLTRGPRDKPTPPDELLPQAIEFVNQYYGSFKEAKIEEHLARVEAVTKEIETTGTYQLTGDELIFATKQAWRNAPRCIGRIQWSNLQVFDARSCSTAREMFEHICRHVRYSTNNGNIRSAITVFPQRSDGKHDFRVWNAQLIRYAGYQMPDGSIRGDPANVEFTQLCIDLGWKPKYGRFDVVPLVLQANGRDPELFEIPPDLVLEVAMEHPKYEWFRELELKWYALPAVANMLLEVGGLEFPGCPFNGWYMGTEIGVRDFCDVQRYNILEEVGRRMGLETHKLASLWKDQAVVEINIAVLHSFQKQNVTIMDHHSAAESFMKYMQNEYRSRGGCPADWIWLVPPMSGSITPVFHQEMLNYVLSPFYYYQVEAWKTHVWQDEKRRPKRREIPLKVLVKAVLFACMLMRKTMASRVRVTILFATETGKSEALAWDLGALFSCAFNPKVVCMDKYRLSCLEEERLLLVVTSTFGNGDCPGNGEKLKKSLFMLKELNNKFRYAVFGLGSSMYPRFCAFAHDIDQKLSHLGASQLTPMGEGDELSGQEDAFRSWAVQTFKAACETFDVRGKQHIQIPKLYTSNVTWDPHHYRLVQDSQPLDLSKALSSMHAKNVFTMRLKSRQNLQSPTSSRATILVELSCEDGQGLNYLPGEHLGVCPGNQPALVQGILERVVDGPTPHQTVRLEALDESGSYWVSDKRLPPCSLSQALTYFLDITTPPTQLLLQKLAQVATEEPERQRLEALCQPSEYSKWKFTNSPTFLEVLEEFPSLRVSAGFLLSQLPILKPRFYSISSSRDHTPTEIHLTVAVVTYHTRDGQGPLHHGVCSTWLNSLKPQDPVPCFVRNASGFHLPEDPSHPCILIGPGTGIAPFRSFWQQRLHDSQHKGVRGGRMTLVFGCRRPDEDHIYQEEMLEMAQKGVLHAVHTAYSRLPGKPKVYVQDILRQQLASEVLRVLHKEPGHLYVCGDVRMARDVAHTLKQLVAAKLKLNEEQVEDYFFQLKSQKRYHEDIFGAVFPYEAKKDRVAVQPSSLEMSAL

SEQ ID NO: 467 - protein, 222 aa, Homo sapiens [sequence omitted]

SEQ ID NO: 468 - protein, 1115 aa, Homo sapiens
MERAISPGLLVRALLLLLLLGLAARTVAAGRARGLPAPTAEAAFGLGAAAAPTSATRVPAAGAVAAAEVTVEDAEALPAAAGEQEPRGPEPDDETELRPRGRSLVIISTLDGRIAALDPENHGKKQWDLDVGSGSLVSSSLSKPEVFGNKMIIPSLDGALFQWDRDRESMETVPFTVESLLESSYKFGDDVVLVGGKSLTTYGLSAYSGKVRYICSALGCRQWDSDEMEQEEDILLLQRTQKTVRAVGPRSGNEKWNFSVGHFELRYIPDMETRAGFIESTFKPNENTEESKIISDVEEQEAAIMDIVIKVSVADWKVMAFSKKGGHLEWEYQFCTPIASAWLLKDGKVIPISLFDDTSYTSNDDVLEDEEDIVEAARGATENSVYLGMYRGQLYLQSSVRISEKFPSSPKALESVTNENAIIPLPTIKWKPLIHSPSRTPVLVGSDEFDKCLSNDKFSHEEYSNGALSILQYPYDNGYYLPYYKRERNKRSTQITVRFLDNPHYNKNIRKKDPVLLLHWWKEIVATILFCIIATTFIVRRLFHPHPHRQRKESETQCQTENKYDSVSGEANDSSWNDIKNSGYISRYLTDFEPIQCLGRGGFGVVFEAKNKVDDCNYAIKRIRLPNRELAREKVMREVKALAKLEHPGIVRYFNAWLEAPPEKWQEKMDEIWLKDESTDWPLSSPSPMDAPSVKIRRMDPFSTKEHIEIIAPSPQRSRSFSVGISCDQTSSSESQFSPLEFSGMDHEDISESVDAAYNLQDSCLTDCDVEDGTMDGNDEGHSFELCPSEASPYVRSRERTSSSIVFEDSGCDNASSKEEPKTNRLHIGNHCANKLTAFKPTSSKSSSEATLSISPPRPTTLSLDLTKNTTEKLQPSSPKVYLYIQMQLCRKENLKDWMNGRCTIEERERSVCLHIFLQIAEAVEFLHSKGLMHRDLKPSNIFFTMDDVVKVGDFGLVTAMDQDEEEQTVLTPMPAYARHTGQVGTKLYMSPEQIHGNSYSHKVDIFSLGLILFELLYPFSTQMERVRTLTDVRNLKFPPLFTQKYPCEYVMVQDMLSPSPMERPEAINIIENAVFEDLDFPGKTVLRQRSRSLSSSGTKHSRQSNNSHSPLPSN

SEQ ID NO: 469 - protein, 551 aa, Homo sapiens
MAGDLSAGFFMEELNTYRQKQGVVLKYQELPNSGPPHDRRFTFQVIIDGREFPEGEGRSKKEAKNAAAKLAVEILNKEKKAVSPLLLTTTNSSEGLSMGNYIGLINRIAQKKRLTVNYEQCASGVHGPEGFHYKCKMGQKEYSIGTGSTKQEAKQLAAKLAYLQILSEETSVKSDYLSSGSFATTCESQSNSLVTSTLASESSSEGDFSADTSEINSNSDSLNSSSLLMNGLRNNQRKAKRSLAPRFDLPDMKETKYTVDKRFGMDFKEIELIGSGGFGQVFKAKHRIDGKTYVIKRVKYNNEKAEREVKALAKLDHVNIVHYNGCWDGFDYDPETSDDSLESSDYDPENSKNSSRSKTKCLFIQMEFCDKGTLEQWIEKRRGEKLDKVLALELFEQITKGVDYIHSKKLIHRDLKPSNIFLVDTKQVKIGDFGLVTSLKNDGKRTRSKGTLRYMSPEQISSQDYGKEVDLYALGLILAELLHVCDTAFETSKFFTDLRDGIISDIFDKKEKTLLQKLLSKKPEDRPNTSEILRTLTVWKKSPEKNERHTC

SEQ ID NO: 470 - protein, 330 aa, Homo sapiens
MSDSEKLNLDSIIGRLLEVQGSRPGKNVQLTENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDVQGWGENDRGVSFTFGAEVVAKFLHKHDLDLICRAHQVVEDGYEFFAKRQLVTLFSAPNYCGEFDNAGAMMSVDETLMCSFQILKPADKNKGKYGQFSGLNPGGRPITPPRNSAKAKK

SEQ ID NO: 471 - protein, 327 aa, Homo sapiens
MADGELNVDSLITRLLEVRGCRPGKIVQMTEAEVRGLCIKSREIFLSQPILLELEAPLKICGDIHGQYTDLLRLFEYGGFPPEANYLFLGDYVDRGKQSLETICLLLAYKIKYPENFFLLRGNHECASINRIYGFYDECKRRFNIKLWKTFTDCFNCLPIAAIVDEKIFCCHGGLSPDLQSMEQIRRIMRPTDVPDTGLLCDLLWSDPDKDVQGWGENDRGVSFTFGADVVSKFLNRHDLDLICRAHQVVEDGYEFFAKRQLVTLFSAPNYCGEFDNAGGMMSVDETLMCSFQILKPSEKKAKYQYGGLNSGRPVTPPRTANPPKKR

SEQ ID NO: 472 - protein, 323 aa, Homo sapiens
MADLDKLNIDSIIQRLLEVRGSKPGKNVQLQENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDVLGWGENDRGVSFTFGAEVVAKFLHKHDLDLICRAHQVVEDGYEFFAKRQLVTLFSAPNYCGEFDNAGAMMSVDETLMCSFQILKPAEKKKPNATRPVTPPRGMITKQAKK

SEQ ID NO: 473 - protein, 674 aa, Homo sapiens
MAPGQAPHQATPWRDAHPFFLLSPVMGLLSRAWSRLRGLGPLEPWLVEAVKGAALVEAGLEGEARTPLAIPHTPWGRRPEEEAEDSGGPGEDRETLGLKTSSSLPEAWGLLDDDDGMYGEREATSVPRGQGSQFADGQRAPLSPSLLIRTLQGSDKNPGEEKAEEEGVAEEEGVNKFSYPPSHRECCPAVEEEDDEEAVKKEAHRTSTSALSPGSKPSTWVSCPGEEENQATEDKRTERSKGARKTSVSPRSSGSDPRSWEYRSGEASEEKEEKAHKETGKGEAAPGPQSSAPAQRPQLKSWWCQPSDEEEGEVKALGAAEKDGEAECPPCIPPPSAFLKAWVYWPGEDTEEEEDEEEDEDSDSGSDEEEGEAEASSSTPATGVFLKSWVYQPGEDTEEEEDEDSDTGSAEDEREAETSASTPPASAFLKAWVYRPGEDTEEEEDEDVDSEDKEDDSEAALGEAESDPHPSHPDQRAHFRGWGYRPGKETEEEEAAEDWGEAEPCPFRVAIYVPGEKPPPPWAPPRLPLRLQRRLKRPETPTHDPDPETPLKARKVRFSEKVTVHFLAVWAGPAQAARQGPWEQLARDRSRFARRITQAQEELSPCLTPAARARAWARLRNPPLAPIPALTQTLPSSSVPSSPVQTTPLSQAVATPSRSSAAAAAALDLSGRRG

SEQ ID NO: 474 - protein, 585 aa, Homo sapiens
MAPSTPLLTVRGSEGLYMVNGPPHFTESTVFPRESGKNCKVCIFSKDGTLFAWGNGEKVNIISVTNKGLLHSFDLLKAVCLEFSPKNTVLATWQPYTTSKDGTAGIPNLQLYDVKTGTCLKSFIQKKMQNWCPSWSEDETLCARNVNNEVHFFENNNFNTIANKLHLQKINDFVLSPGPQPYKVAVYVPGSKGAPSFVRLYQYPNFAGPHAALANKSFFKADKVTMLWNKKATAVLVIASTDVDKTGASYYGEQTLHYIATNGESAVVQLPKNGPIYDVVWNSSSTEFCAVYGFMPAKATIFNLKCDPVFDFGTGPRNAAYYSPHGHILVLAGFGNLRGQMEVWDVKNYKLISKPVASDSTYFAWCPDGEHILTATCAPRLRVNNGYKIWHYTGSILHKYDVPSNAELWQVSWQPFLDGIFPAKTITYQAVPSEVPNEEPKVATAYRPPALRNKPITNSKLHEEEPPQNMKPQSGNDKPLSKTALKNQRKHEAKKAAKQEARSDKSPDLAPTPAPQSTPRNTVSQSISGDPEIDKKIKNLKKKLKAIEQLKEQAATGKQLEKNQLEKIQKETALLQELEDLELGI

SEQ ID NO: 475 - protein, 1001 aa, Homo sapiens
MEAAHAKTTEECLAYFGVSETTGLTPDQVKRNLEKYGLNELPAEEGKTLWELVIEQFEDLLVRILLLAACISFVLAWFEEGEETITAFVEPFVILLILIANAIVGVWQERNAENAIEALKEYEPEMGKVYRADRKSVQRIKARDIVPGDIVEVAVGDKVPADIRILAIKSTTLRVDQSILTGESVSVIKHTEPVPDPRAVNQDKKNMLFSGTNIAAGKALGIVATTGVGTEIGKIRDQMAATEQDKTPLQQKLDEFGEQLSKVISLICVAVWLINIGHFNDPVHGGSWFRGAIYYFKIAVALAVAAIPEGLPAVITTCLALGTRRMAKKNAIVRSLPSVETLGCTSVICSDKTGTLTTNQMSVCKMFIIDKVDGDICLLNEFSITGSTYAPEGEVLKNDKPVRPGQYDGLVELATICALCNDSSLDFNEAKGVYEKVGEATETALTTLVEKMNVFNTDVRSLSKVERANACNSVIRQLMKKEFTLEFSRDRKSMSVYCSPAKSSRAAVGNKMFVKGAPEGVIDRCNYVRVGTTRVPLTGPVKEKIMAVIKEWGTGRDTLRCLALATRDTPPKREEMVLDDSARFLEYETDLTFVGVVGMLDPPRKEVTGSIQLCRDAGIRVIMITGDNKGTAIAICRRIGIFGENEEVADRAYTGREFDDLPLAEQREACRRACCFARVEPSHKSKIVEYLQSYDEITAMTGDGVNDAPALKKAEIGIAMGSGTAVAKTASEMVLADDNFSTIVAAVEEGRAIYNNMKQFIRYLISSNVGEVVCIFLTAALGLPEALIPVQLLWVNLVTDGLPATALGFNPPDLDIMDRPPRSPKEPLISGWLFFRYMAIGGYVGAATVGAAAWWFLYAEDGPHVNYSQLTHFMQCTEDNTHFEGIDCEVFEAPEPMTMALSVLVTIEMCNALNSLSENQSLLRMPPWVNIWLLGSICLSMSLHFLILYVDPLPMIFKLRALDLTQWLMVLKISLPVIGLDEILKFVARNYLEDPEDERRK

SEQ ID NO: 476 - protein, 1042 aa, Homo sapiens
MENAHTKTVEEVLGHFGVNESTGLSLEQVKKLKERWGSNELPAEEGKTLLELVIEQFEDLLVRILLLAACISFVLAWFEEGEETITAFVEPFVILLILVANAIVGVWQERNAENAIEALKEYEPEMGKVYRQDRKSVQRIKAKDIVPGDIVEIAVGDKVPADIRLTSIKSTTLRVDQSILTGESVSVIKHTDPVPDPRAVNQDKKNMLFSGTNIAAGKAMGVVVATGVNTEIGKIRDEMVATEQERTPLQQKLDEFGEQLSKVISLICIAVWIINIGHFNDPVHGGSWIRGAIYYFKIAVALAVAAIPEGLPAVITTCLALGTRRMAKKNAIVRSLPSVETLGCTSVICSDKTGTLTTNQMSVCRMFILDRVEGDTCSLNEFTITGSTYAPIGEVHKDDKPVNCHQYDGLVELATICALCNDSALDYNEAKGVYEKVGEATETALTCLVEKMNVFDTELKGLSKIERANACNSVIKQLMKKEFTLEFSRDRKSMSVYCTPNKPSRTSMSKMFVKGAPEGVIDRCTHIRVGSTKVPMTSGVKQKIMSVIREWGSGSDTLRCLALATHDNPLRREEMHLEDSANFIKYETNLTFVGCVGMLDPPRIEVASSVKLCRQAGIRVIMITGDNKGTAVAICRRIGIFGQDEDVTSKAFTGREFDELNPSAQRDACLNARCFARVEPSHKSKIVEFLQSFDEITAMTGDGVNDAPALKKAEIGIAMGSGTAVAKTASEMVLADDNFSTIVAAVEEGRAIYNNMKQFIRYLISSNVGEVVCIFLTAALGFPEALIPVQLLWVNLVTDGLPATALGFNPPDLDIMNKPPRNPKEPLISGWLFFRYLAIGCYVGAATVGAAAWWFIAADGGPRVSFYQLSHFLQCKEDNPDFEGVDCAIFESPYPMTMALSVLVTIEMCNALNSLSENQSLLRMPPWENIWLVGSICLSMSLHFLILYVEPLPLIFQITPLNVTQWLMVLKISLPVILMDETLKFVARNYLEPGKECVQPATKSCSFSACTDGISWPFVLLIMPLVIWVYSTDTNFSDMFWS

SEQ ID NO: 477 - protein, 1043 aa, Homo sapiens
MEAAHLLPAADVLRHFSVTAEGGLSPAQVTGARERYGPNELPSEEGKSLWELVLEQFEDLLVRILLLAALVSFVLAWFEEGEETTTAFVEPLVIMLILVANAIVGVWQERNAESAIEALKEYEPEMGKVIRSDRKGVQRIRARDIVPGDIVEVAVGDKVPADLRLIEIKSTTLRVDQSILTGESVSVTKHTEAIPDPRAVNQDKKNMLFSGTNITSGKAVGVAVATGLHTELGKIRSQMAAVEPERTPLQRKLDEFGRQLSHAISVICVAVWVINIGHFADPAHGGSWLRGAVYYFKIAVALAVAAIPEGLPAVITTCLALGTRRMARKNAIVRSLPSVETLGCTSVICSDKTGTLTTNQMSVCRMFVVAEADAGSCLLHEFTISGTTYTPEGEVRQGDQPVRCGQFDGLVELATICALCNDSALDYNEAKGVYEKVGEATETALTCLVEKMNVFDTDLQALSRVERAGACNTVIKQLMRKEFTLEFSRDRKSMSVYCTPTRPHPTGQGSKMFVKGAPESVIERCSSVRVGSRTAPLTPTSREQILAKIRDWGSGSDTLRCLALATRDAPPRKEDMELDDCSKFVQYETDLTFVGCVGMLDPPRPEVAACITRCYQAGIRVVMITGDNKGTAVAICRRLGIFGDTEDVAGKAYTGREFDDLSPEQQRQACRTARCFARVEPAHKSRIVENLQSFNEITAMTGDGVNDAPALKKAEIGIAMGSGTAVAKSAAEMVLSDDNFASIVAAVEEGRAIYSNMKQFIRYLISSNVGEVVCIFLTAILGLPEALIPVQLLWVNLVTDGLPATALGFNPPDLDIMEKLPRSPREALISGWLFFRYLAIGVYVGLATVAAATWWFVYDAEGPHINFYQLRNFLKCSEDNPLFAGIDCEVFESRFPTTMALSVLVTIEMCNALNSVSENQSLLRMPPWMNPWLLVAVAMSMALHFLILLVPPLPLIFQVTPLSGRQWVVVLQISLPVILLDEALKYLSRNHMHACLYPGLLRTVSQAWSRQPLTTSWTPDHTGRNEPEVSAGNRVESPVCTSD

SEQ ID NO: 478 - protein, 427 aa, Homo sapiens
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDLWSVGCIMGEMVCHKILFPGRDYIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLGAAVINGSQHPSSSSSVNDVSSMSTDPTLASDTDSSLEAAAGPLGCCR

SEQ ID NO: 479 - protein, 424 aa, Homo sapiens
MSDSKCDSQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMGELVKGCVIFQGTDHIDQWNKVIEQLGTPSAEFMKKLQPTVRNYVENRPKYPGIKFEELFPDWIFPSESERDKIKTSQARDLLSKMLVIDPDKRISVDEALRHPYITVWYDPAEAEAPPPQIYDAQLEEREHAIEEWKELIYKEVMDWEERSKNGVVKDQPSDAAVSSNATPSQSSSINDISSMSTEQTLASDTDSSLDASTGPLEGCR

SEQ ID NO: 480 - protein, 745 aa, Homo sapiens
MERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGSLCTSFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMELQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 481 - protein, 756 aa, Homo sapiens
MSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGSLCTSFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 482 - protein, 419 aa, Homo sapiens
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAKQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 483 - protein, 404 aa, Homo sapiens
MADKVLKEKRKLFIRSMGEGTINGLLDELLQTRVLNKEEMEKVKRENATVMDKTRALIDSVIPKGAQACQICITYICEEDSYLAGTLGLSADQTSGNYLNMQDSQGVLSSFPAPQAVQDNPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDSPGVVWFKDSVGVSGNLSLPTTEEFEDDAIKKAHIEKDFIAFCSSTPDNVSWRHPTMGSVFIGRLIEHMQEYACSCDVEEIFRKVRFSFEQPDGRAQMPTTERVTLTRCFYLFPGH

SEQ ID NO: 484 - protein, 479 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKERSSSLEGSPDEFSNGEELCGVMTISDSPREQDSESQTLDKVYQMKSKPRGYCLIINNHNFAKAREKVPKLHSIRDRNGTHLDAGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 485 - protein, 208 aa, Homo sapiens
MDPFLVLLHSVSSSLSSSELTELKFLCLGRVGKRKLERVQSGLDLFSMLLEQNDLEPGHTELLRELLASLRRHDLLRRVDDFEAGAAAGAAPGEEDLCAAFNVICDNVGKDWRRLARQLKVSDTKIDSIEDRYPRNLTERVRESLRIWKNTEKENATVAHLVGALRSCQMNLVADLVQEVQQARDLQNRSGAMSPMSWNSDASTSEAS

SEQ ID NO: 486 - protein, 246 aa, Homo sapiens
MSLQWTAVATFLYAEVFVVLLLCIPFISPKRWQKIFKSRLVELLVSYGNTFFVVLIVILVLLVIDAVREIRKYDDVTEKVNLQNNPGAMEHFHMKLFRAQRNLYIAGFSLLLSFLLRRLVTLISQQATLLASNEAFKKQAESASEAAKKYMEENDQLKKGAAVDGGKLDVGNAEVKLEEENRSLKADLQKLKDELASTKQKLEKAENQVLAMRKQSEGLTKEYDRLLEEHAKLQAAVDGPMDKKEE

SEQ ID NO: 487 - protein, 192 aa, Homo sapiens
MDGSGEQPRGGGPTSSEQIMKTGALLLQGFIQDRAGRMGGEAPELALDPVPQDASTKKLSECLKRIGDELDSNMELQRMIAAVDTDSPREVFFRVAADMFSDGNFNWGRVVALFYFASKLVLKALCTKVPELIRTIMGWTLDFLRERLLGWIQDQGGWDGLLSYFGTPTWQTVTIFVAGVLTASLTIWKKMG

SEQ ID NO: 488 - protein, 211 aa, Homo sapiens
MASGQGPGPPRQECGEPALPSASEEQVAQDTEEVFRSYVFYRHQQEQEAEGVAAPADPEMVTLPLQPSSTMGQVGRQLAIIGDDINRRYDSEFQTMLQHLQPTAENAYEYFTKIATSLFESGINWGRVVALLGFGYRLALHVYQHGLTGFLGQVTRFVVDFMLHHCIARWIAQRGGWVAALNLGNGPILNVLVVLGVVLLGQFVVRRFFKS

SEQ ID NO: 489 - protein, 239 aa, Homo sapiens
MAHAGRTGYDNREIVMKYIHYKLSQRGYEWDAGDVGAAPPGAAPAPGIFSSQPGHTPHPAASRDPVARTSPLQTPAAPGAAAGPALSPVPPVVHLTLRQAGDDFSRRYRRDFAEMSSQLHLTPFTARGRFATVVEELFRDGVNWGRIVAFFEFGGVMCVESVNREMSPLVDNIALWMTEYLNRHLHTWIQDNGGWDAFVELYGPSMRPLFDFSWLSLKTLLSLALVGACITLGAYLGHK

SEQ ID NO: 490 - protein, 233 aa, Homo sapiens
MSQSNRELVVDFLSYKLSQKGYSWSQFSDVEENRTEAPEGTESEMETPSAINGNPSWHLADSPAVNGATGHSSSLDAREVIPMAAVKQALREAGDEFELRYRRAFSDLTSQLHITPGTAYQSFEQVVNELFRDGVNWGRIVAFFSFGGALCVESVDKEMQVLVSRIAAWMATYLNDHLEPWIQENGGWDTFVELYGNNAAAESRKGQERFNRWFLTGMTVAGVVLLGSLFSRK

SEQ ID NO: 491 - protein, 505 aa, Homo sapiens
MRLRRLALFPGVALLLAAARLAAASDVLELTDDNFESRISDTGSAGLMLVEFFAPWCGHCKRLAPEYEAAATRLKGIVPLAKVDCTANTNTCNKYGVSGYPTLKIFRDGEEAGAYDGPRTADGIVSHLKKQAGPASVPLRTEEEFKKFISDKDASIVGFFDDSFSEAHSEFLKAASNLRDNYRFAHTNVESLVNEYDDNGEGIILFRPSHLTNKFEDKTVAYTEQKMTSGKIKKFIQENIFGICPHMTEDNKDLIQGKDLLIAYYDVDYEKNAKGSNYWRNRVMMVAKKFLDAGHKLNFAVASRKTFSHELSDFGLESTAGEIPVVAIRTAKGEKFVMQEEFSRDGKALERFLQDYFDGNLKRYLKSEPIPESNDGPVKVVVAENFDEIVNNENKDVLIEFYAPWCGHCKNLEPKYKELGEKLSKDPNIVIAKMDATANDVPSPYEVRGFPTIYFSPANKKLNPKKYEGGRELSDFISYLQREATNPPVIQEEKPKKKKKAQEDL

SEQ ID NO: 492 - protein, 597 aa, Homo sapiens
MAAVQAAEVKVDGSEPKLSKNELKRRLKAEKKVAEKEAKQKELSEKQLSQATAAATNHTTDNGVGPEEESVDPNQYYKIRSQAIHQLKVNGEDPYPHKFHVDISLTDFIQKYSHLQPGDHLTDITLKVAGRIHAKRASGGKLIFYDLRGEGVKLQVMANSRNYKSEEEFIHINNKLRRGDIIGVQGNPGKTKKGELSIIPYEITLLSPCLHMLPHLHFGLKDKETRYRQRYLDLILNDFVRQKFIIRSKIITYIRSFLDELGFLEIETPMMNIIPGGAVAKPFITYHNELDMNLYMRIAPELYHKMLVVGGIDRVYEIGRQFRNEGIDLTHNPEFTTCEFYMAYADYHDLMEITEKMVSGMVKHITGSYKVTYHPDGPEGQAYDVDFTPPFRRINMVEELEKALGMKLPETNLFETEETRKILDDICVAKAVECPPPRTTARLLDKLVGEFLEVTCINPTFICDHPQIMSPLAKWHRSKEGLTERFELFVMKKEICNAYTELNDPMRQRQLFEEQAKAKAAGDDEAMFIDENFCTALEYGLPPTAGWGMGIDRVAMFLTDSNNIKEVLLFPAMKPEDKKENVATTDTLESTTVGTSV

SEQ ID NO: 493 - DNA, 5918 bp, Homo sapiens
gccagaaatcttctcccaaaaatatatacagcattggatgtcagcactccggcaagtagttcatgtcaatgtatttctgtgccatcctgaacttgtttctaatccaaaaagaaagtgattcatttttgccctttaggaaacaggagcaattttcatattgtgaaattttggcaaaggtctcctcttcacaataggcaaaggggagaaagctgcatttggtaccatctgtcaattataaatccttcaaaactagcaatgacacagaaataaaatatgtagtatgaatgtggacaatacaatatacatgtacaatcctgttaggaagaattgtcttcatatagctcatatccttctttcttaaggcattaaagcattttatacttcctatgtatcctattacttcctttttggcgttattaagattaaaatacttgataactttgtaactctgttttcctgacatgactcaattatcattaagtaatacttatcaataaataataatctaataaaacgttacagcttaaaatacaatagtgtggactataatattatttctttattatgtggtaaccccatgggaaaaccaacatattaattaggatgcttctagctgttagccacagaactccaactaactgtggtataaaataaataaccagtatgttgagcaatgagaccgtaaggtgtgtaattagacagtacctttatttaaaggcattttagtctcttattaagatgtattcaatatggaaacttttgttcatgccactggatgaaaactcagacactcaggcactcatgatatttctaacaactcttaggctaaattaataggtagtagatagatagatacataaatacatacatacatacatagatgatagataaatgatttagagtcatttaagtttgaaaacttgttcaagcttcataattaaacatttcccaccctagataataatcacagctttgaatacgattttaagttacgacattctcccttcctaatgctgggggcttctgaaggcaggaagctggagaaagggcacaaactgctgtccttcctcctctttcatctccgtccctccttcttaatcctactggtcatgcttgttgactttcttcagggccaaaccagcctgagcagctgggagagaagatggtaaaggaaaagagaataattcttacttgactggcactgtgactgttactctcacatgattacatgagatctgaccatcgatgaaaagtgagtcttcttcttggggattttcatagtttattcagaaaccaccaatgaaaacaggcacttcctatgatgtaggtgaagcattttcctctccctctgaccatttttctctgcttcagaatttttcatcagccattcctcacggtctctctcagttgtggtcccactgcccttccagatggccctcacttggacacatttagaatggccccagactccagattatcacctatagctcaccccgtcccactgccactccctatctctttctctctctcttgtataacccacatctaatctttggtgtttcagtccattcagactgctataagaaagtaccataaactcggtggcttggggctgggaatggtggctaatgcctgtaatcccagcactttggggagccaagatgggagactcacttgaggctaggagttcattaccaacctgggcaacatgtgagaccccatctccacaaaaaaaatttttaataaaaaaataattttttaaaaaataggtggcttataaacagtaggagtttattgctcacacttctggagtctagaaagtccaagatcactttgccagccgattcagcatctgctgaaggcctgttcctcatagatggctttttcatgatgcatccccctccatcccctgtagaagaggaaaaacaacttccctcaggcttcttttaaaagggtattcatcctatccacatgggttttgctctcatgatgtaatcaccttccaaaggccctacttcttaataccatcaccttggggggttaggttttaacatatgaattttagagggtcacagacattcagaccatagcacttgggagagtctcattcttccttttgccccaaaatctctgcgactgcaggcccatgccaactctgaccacctctactgtggggctcatctctcacattttcaattgtcctatcaggagcagccactggccctctgttcccctcgctgcaggggacacgtgcctagatcttcttaaagaccctttatattgactagaggtaaaggaggaagcaatatttacccgttctctttaggaaatatatttcactaaccctatatatccatgatatgtaaggggttcaagaacttataatcagatcttcgccacctgctttgaatattgttttcatgccataactgaaactgaagaagaaaaagttccatttaatgcccttaaacctcatacaaaagagagactggaaggagaaattccaggtttggttaattcagcagttcaacaatgtcagtgctcttactgtttctctgtgatcctccagttttctcttctcatggtcataagaaagccactgcagggtcaagcatcatgtccacatttgaaaacagctaaagacaagaagggaaaagtacctgtcttgtgtccgtctttatagccaggaaaaacttctcagaaattctcaataagccttttcttaacatcttgaaaggcagagctgcttcacatgccccgacctatagcaatctctaacaagaggaatggaatgactgcaattggcttaaactagttgcctcccttaagaaagtgtggcacatatacaccatggaatactaagtagccataaaaagaggatgagttcacgtcctttgcagggacatggatgaagctggaaaccatcattctcagcaaattatcacaaaatcagaaaaccaaacaccacatgttctcactcataaatgggagttgaacaataagaacacatggacacagggaaaggaacatcacacaagggggcctgtagggggtggggggctaggggagggataacattaggagaaatatctaatgtaggtgatgggttgatgggtgcagcaaatcaccatggcacgtgtatacatatgtaacaaaactgcacattctgcacatgtaacccagaacttaaagtacaatcaatcaatcaatcaatcaatcaatccagttgcctcccaagaagtatgagaccctgggtccaggacttttatgtaaaatatgatacactggagtacaagaggaaaatattaatgccacctcaatatttcttatccctgactttttaaactttaatatttgggttcttattttattttattttaagatggaatctttctctgtcgcccagactggagtgcagtgctgcgatctcggcacactgcaacctctgcctcccaggttcatatcttgaaataactattcttgattttcctagtctgacccaccctaccctccccaaccaccccaccccccactcaccaccatgtcctcagcctctcaatgtcataattttggttactcccatatttgttttttggtttttggtttttggtttttttttgaggcagagtatcgctctgttgtccaggctggagtgcaatggcacactctcagctcactgcaacctccgcctcctgggctcaagccattctcctgccctcagcctctcgagtagctgggattataggtgtgcgccaccatgcccagctagcttttgtatttttagtagagataaggtttcaccatgttggccaggctggtctcgaactcctaacctcaagtgatctgcctgcctcggcctcccaaagtgctgggattacaggcgtgagccaccgcaccctgcctggttacctcagtatttgaagttcactgctgggccatgcagtacattgtgacaaatttttcttttctgcctaagtttttgttttcctccaattcaacccctatctctcttccaggtgtctaaatttcctcataagacattcagatacagcaagtattgtattacttctattttctcacaggaatctcccctggagttttctgacccagttcacaataaactggttgccatcttgcctcatgtagcatttcctctgctttcttcatcaccatcttgggtttcactttgcctcttttctgtgttggatcctctgttttctgaaacctatgacatgcatttttttctgtttacttttttgttttgctaacccacatcctccagtggctttctgagaaaaaagtacatggggcatatgtttctcgagagcatacatatttgaaaaatctttaattgacattcctacttaagtcataatttcactgggtatggaatcctagagtggaaataaatttccttcacaatgttgaaagcattgctctaatcctgcctagcttccagtagtgttattgagaagtctaaagaaattctgatttcagatcctatgtttgtgatttgtatttgtttctggaagcattcaggatcttatctttgactcctgtgttctgaaagtgcccaaagatgtgctttcatatgggtctattttatacgttgtactgggctctcaacgggtccttttggcctaggaaaccatgtcctacaattctggaaacttctcttgaattattccattggtggtctctcttcagtttctctactttctcttcctaaaattcaaatgatattcaaatggaccacctggactggtcctccaattttgtatcttatcttcttttttctatatgttcgtttttgtccaaattttgagaaagtgtctcagctttacattccaagccttctttttttttttttttttttttagacggagtctcgctctgtcgcccaggccggactgtggactgcagtggcgcaatctcagctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgaccttgtgatccacccgcctcggcctcccaaagtgctgggattacaggcgtgagccaccgcacccggcctccaagccttctttgcttccttgccactagtgtttttaaattctaagaattcaaactccttttctgcatattacaatactccaattttatagcatcatcctgttgtttcacggatttatgatatctttcagaggatatagatgatagttgagttgtggctatgttgttgttgctgttctgtttttttccttctatgtttccttcaagttgcttttgtcttcttgaaagttttagtctccatgttttatggtacatgtgaatggtgatttttggttatcttatattcagaagttagggaccaaacaatagttgattgtaaggctcaagtcagctggcagggtgtatgtattacaaggatcactgtagagttacaggcctggaatgttttatagggagaacccctgacatcaaaacttttagcatttctatcctaatatttgatgtagtctgattcctcagagaaggggtgacaaatctcctgcctcatggacatgggcctgactgcaagtctctggaataagatagaagaaaaagaccggcattctcaaaattcagaatataagcattcacttcttcctccttctatctggcatccccagtccagagaatgtgtctgatgagggaaccatccctcttctggctgggttggagaggaactgtcacctagtgcaaggagtagagggggcatcagagactctcacctatttattgatatgttttggctgtgtccccacccaaatctcatcttgaatt

SEQ ID NO: 494 - DNA, 4972 bp, Homo sapiens
atcttggctaacccggtgaaaccccgtctctactaaaactacaaaaaattagccgggcgcggtggcaggcgcctatagtcccagctactcggtaggctgaggcagaagaatggcgtgaacccaggaggcggagtttgcagtgagccgagatcgggccactgcactccagcctgggctatagagcgagactccgtctcaaaaaaaaaaaaaaaaaaaaagggaatgaatacatctggtttttaaagagaacatgcacacaaacaacccatgagcatcaacagcttttcaaacctgcaacaggtacaccttaaaaaaaaaaagacacccacaattgcacctgtccaattgccagtttcatagcaccaggaagtaaattagccctaccttcctttatgcatatagacttgttctatttctttagcattagcagaaagttttttgtaaatgtataaacagcaaaatctagtagtattaagttactccaaaatccttatattaccatttgctcccaattattttattaactaggggtaattcagggagatacgtgcatttttcaaaacaccatgcattacggttagttgtacatatatatgatcctaccctattagattgttggcttctcaaaaacaaaagctgcgttttagatcttccaaacatagctgtttttacacggagatgcacttatgtactgaatgtataacttaaaatagatttaaaactatcccagcatctactgcaagttatttggcagcaaagatttaagttcacagattcgtggaattaatcctacacactgaaaggaaaagttgactgctcttcagaaaaagttcttatccctcttctaaaataaaggaaaaatgaaagaaaggtaagttgagacccaggatcattcaaggatcgtatctgtccctagtctggccaattacaaactagtatttgaacttgttttaaatcttaggtgaaaatacagttaagaattccaagacccaaatccaaaaaagtctgcttttacagtgaacgatattcttaggagcttctcacatccactttaaattcaacaaaagcagccgggcacggtggctcacgcctgtaatcccagcactttgggaggctgaggcgggcggatcacgaggtcaggagatcaagaccgtcctggctaacacggtgaaaccccgtctctactaaaaatacaaaaaattagccgggcgtggttgcaggcgcctgtagtcccagctactctggaggctgaggcaggagactagcctgaacccaggagacggagcttgcagtgagccaagatcgcgccactgcactccagcctgggcgacagagcgagactccatctcaaaaaaaaaattcaacaaaagctacttacaaaagaactctaacagataagccaacccttcccaccctatggtgcctattttcttctggctcagaggaaggaaaataggctgacaccaatttgctacataaagaccctttcatctaagaatttcaaaatgccttagaaaactatattctcccaacctgcttataaagtattactaataccatttacagggatttctcaggagataacagcccacacaacttgctcagagcaacagagcatatcgaggcaaacattaagttgtgatttacagtgctgaatgcattctatgctagatctccaagaactttattaacatgtaacttagatcatcctaagaaaggcagacttgcattatgttccacctttaaaaatctgcctttaggccaggtgcggtggctgacacctgtaatcccagcactttgggaggccgaggtgggtggctcacctgaggtcaggagtttgagaccagcctgatcaatatggagaaaccacgtctctactaaaaatagaaaattagctgggcgtggtggcacatgcctgtaatccctgctacttcaacctgggaggcagaggttgcgggtgagacaagattgcaccattgcactccagcctgggcaacaagagcgaaaccccgcctcaaaaacaaaacaaaacaaaacaaatctgcctttagacattgctacaaagtaaaacaatctcaagttcaataactctccccaatcatataaagaatgggatttccatgccggttaatctttaagtcattaaacagtgatttcctaacctaaggtccaagtgctactaataattatttaaatgaagcttaaaaagaagaaactgcactactgataaatttgtctgtgaccaggaatagaaagcaagaagcgcactggtacttcaaagaaaccagtggcgtctaccttattcccgcagtatagactagttcaggcaaccatgagactgagttgcctcagagataatttagctcccctctttcccctttttcctctttcttcgctcaagagttgctacccagggttcaatacagacctccatttcctttcctcttttcttcacccttttctcctatattttcagttccttttctaggagtttaggttaattccaagcattcttgagctctttcccacaacccatactgctcaacacaaacgtgatagggtggatgacaaaggtcacatgtctccctgtaaccaaataaaggaagaagtcacgagtccactatttttctccagtgaggttttgctgttaacacttacctataacaaatggatttttaagagactttttggagccaaagccaggaatcagtcaggtttgagtcccacactctaacatatacacttatcctaatagctacctccctaaacttttctgttccttctttcatagcagcttttctcccttcataccaccatggcttctgtttaatattgagttgtgaagaaatgtggtaaaattcctagtttgatttgccagaattagcaggacattaggtatagtttctctttcatcttaacttttttttttttttttttgagacggagtcttgttcttgtcacccaggctggagtgcaatggcacgatctcggctcactgcaacctacaccccccggactcaagtgattctcctgcctcagcctcccgagtagctgggattacaggcacgagtcaccacgcctggctaatttttgtattcttagtagagacagggtttcagcatgttgaccaggctggtctcgaactcctgacctcgtgatccgcccgcctcagcctcccaaaatgctgggattacatgcgtgagccactgtgcctggcagtttctctttcatcgtaattttctttaaagttatgtttgtgtgtatatattttgtgttttgttattattaaaggtgaactttgctatgataagacagatatctgtatttttttttttaatgaaaattagtttctgaaaagaccacagactgtgggaggggacgatctgggttccaatcttgacctattacctattagtattatcttagccagcttgcttaacctctcagcctccagtgtctttatttataagacgggaatactactgcagttgacccttgaaggaaacagctttgaattgcacagatccacttataccaaaagcaataaaaaatacaggtctgcctgctccttaaagaggaaaaagcttgtgagaaataaagaaataaatactgtatttgtgagatgtgatgtttcacatccggtgaatacagagagctgactttccatatatgctggttccacagggtggactttgggacttgagtatgtatgaatttgggtatacacaagggtcctggaaccaatcccctgaagataccgagggacaactgtatttataccatataattactacagtgaatgaaaattatgtaatatatctgacagtgttttcaactactgagtaggtacttaataaatcaaacaatcccaaagatagcaaatgtaaaaaaaaaaactgtatacaaaccagtagtttcacttctgaatgttgctttaggaacagaaaaaaatttaattttttttattttttatttttattttagatagagtctcgcttggttgcccaagctagagtgcaatggtgtgatctcagctcactacaacctccgcctcccgggttcaagtgattctcctgactcagcctcccgagtagctgggattacacgtgtgtgccaccgcgcccagctaagttttgtatttttagtagagatggggtttctccatgttggccaggctagtctcaaactcctcatctcgtgatccacctgcctcagcctcccaaagtgctgggattacaggtgtgagccactgcgcccggccccagaaaaatatttttaaaggttaaatcagtaaggaggaacacaggaatatattccactataacaaataccagtgaaaagaaatttgccatataacaaaattttaaaaacctacgaaggcttcaactattcaaagtgtgtacagtaacactttgaagggtaattctctgtaccagatattctgaagcagatccacaaatagtctgagtttatatgcaaaattatttatgtgcatttttctcaggaatagctccttagatttcagcagattcttaagtctagtatctaaaagaggctttgaataactgctttattcaaataagatggcattattattggagaagtaaaagagtctcactaaataatctggactcactcatttgaaatactttggagtagataaaatctccacccttgctctgtggtcaaatcatatacttaatgacactttaaaaacccagtgctggctgacttgccaagcctcaagaatataaataagggcgtgagatgaaaagaacaacctttcaggttacgagagcctccacaacacctcaaaaggcagcaatgactaggagtgttattttgatagacagggagggtaagaaggactgggtatgtggctactaaaggatgcagcattctaggaactccactcagggatcaaatgaaaaatatctgcattattagtttccacttactttcttcgaaaatt

SEQ ID NO: 495 - DNA, 12876 bp, Homo sapiens
tgctcagggtccctggaaagttccttcccttgcaaagtgcttagtgtgttaccaatagaccccagcaagacattgacccaaatgttgtcctctgtgtgtgtacgtgtgtgtgtgcgcatatgtgtgtgcatgtgtgtgtacatgtctgtgtgtgcgtgtgtgtgcatgtgtgtgcgtgtgtgcatgtgtgtgtgtgtgcatgtactgcacaccgagcacctgcctgtggatggtgtacacacaaacacacccaccctgcacagacacagaggcaagccgccatccacacatcgcgtcacctcctcggtggaaggcacagtagtgaccctggcatttcgtttttctagtttggttttgtccaagctggcttgtgaggtgcaggtgtcctcctgcatccagggcagggcaatgtggtctgtggctgtggtggtgtgtgggggacagatgaaggtggaagctcgcactgcaccccaccactgagcaccggatgagggcgaagggctgtccgcctcactggactccccgtgactgcatctacctgcttgctctggccagacctccccactagagcatggtccaccccaatgcccgcctccacccctctccttcagcacaggccaagcctccattccccctcccaacgtccaccctccctggcctgtgccactgcatggactcctgacttccttcccatccttacggggtggtcggcctgtgctgtctcaggtcctgagctgcccctcccttcccaagccatgcaccagggtccagcccagtgaggccatgtggtgaggggatgagccatggcctccatcaggacaagtggggctgtctctacaagagggctttcctcttccaccagtcttgggtgccagggagagaggcaaatatgggtagtggtgggtacattggctagatcagagggggctggcttcccagaagttgggagggtcccttttaaagtcatagaaagtcacacacctgcttgagataacagtagcacttttggtacctgctaaaggcaacacttactcccaatcccacaacgctgtcagaggactttgcatttcatcgcaacaggattgagatgactgaaagttgctgagcaaacctcagatgaatgaataatcacagaagggttacttggtgactttcacgcagtgtttgtgggcacagggttcctgaggttttgcagaacaccccagcaaggatcttgttgtggtgtcgatggctgcaggccacaggctgggaccccctgtcacacagggcaagagacctcccctggcagcctgtgctagccccccaggccaggcctgcagggaaagggggctaggggctggaactgatctcacgacagcctgtcctcggctccagcatgtggctccctggcttctggccacggctggctgggtcccctgtggcaggagctggccatcctggagttcaagggcccctgaagcactgcccacgcctgatcttcctccccagtgttctctccgctccaggggaagtgagacagcccagcccaggcaaacaggtccagctgcagctggcagccagtcccaagaacgctgccactcggccctccccgctgacctctgcacaccctcgcccggcgccctgccaggccttattcatgggctggcagtgccaggacctctcccggaggcggggcagagcagcagcttctcggccctgtgccgagcccaggcctgcaccctaggcaggcactgctccgtgatccaggaaccacctctctctacagctgggagtgagcagtcagagagggagacagccttgcccggtgctacccagcaagctagtcaccgagtgggcagagggaggagcggccctcaccggatgtcaagcagcctgggtccccagtccagctctgcctgtccctcgcaataacgcctcaggtatgttacggaccactcagcttgtttccctgtaaggaaacgtcccttctcccttgaaatatgtccctttctatcctcccggggccctcgcaggccaacagccaggaaggttggagctgagctgggctggcggtagcaacagcagctttctctcctgcattggctccagcaagtcttgctcagacgttggtggggtggggtggggagggtcaccgaggcagggaggagcctgggggttgtcctgtcgtcctcctgggcccctagagtagaaagggcacgtgaggaccatcgagggtccgaggggcatggacaggtgtgaggggactcacgggggtgggtgaggtgggggaaggagcttcccagagcagcacgggggcccaagcccaccctcctcgccacccctgccccacgaggccgtctgggttggggatgccccaggggggcctttgcgcaaacgtctccactggcaacagccggtcgcttggcaacccgcacgccccaggcccctgcgccccggggagccccgagtggggcgggggtgccccgcggctcagcgaagcccctcctgcagcgggcaggggaggggtgcaggcagcaaatggaaagcgctcacccaccccagagccagccgggaagtccttgctggagctgctctccggcactggggcacctgggcagccatgtgctgccacccaggaaggcaggagacccaggctgctccccaggatcctggcaagccccttcccttctgggacaatagaggcagcaaggccttctccgggggctgggtgaggagagagggcctgcaggtgtgaggcatctgttgaggcacaaaccagaggctgtgctcagctcagcaaaacacagtgcctgtgggtggtgggtggcagggtcatttcaggtgggatccaggatgttcaaagtgacatccaactctgggctggtccctctggggtcggctgggggctaagggcagcagctggacatgcctcttcctggaccctgggagctggtcgcctacagagcccaagctaggagctgctggcagtcattgtgactaggggtccccccatgcagtgcctgcattttagggagacattagccacccttgacgccagcctgatttggggtttagtcaccactcagggccatgcattccaaccaaaaagttacaggcgtccccatcttaactagcaccaaacccagcagtggggccgatgaacttggccaagcagcctgtgccaggatcctggtagaaagtgggtttgggcagctgcaggtgtgaaacatggcttagcttctctcctgggactggggcaggctccagttcagcagcccacctgaggcacctgcaaacacaggtgagcttttacacacgcccagcccccagagaaggccggggaggccttgccacctctgttttctcagaagggaaggggcttgccagcatcctggggaggcgtctgggtctcctgccttcctgggtggcagcatgtggccgcccaggtaccccagcgccggagagcagctccagcaaggacttcccggctggctctggggcaggcgagcatttcccctttgcctttacacacctgggcttctgcggtttcccaagggctctggtgaggaaacgggcttaggtgctgagaggggggcgcataggagtgggggcatttggccagggtggctgagtcccagcgccaccgttccgcacccggaaaccttggctgtgatgcttctctgtggcttctaacctggaacccgggggacatccccttgccccagtgccttctcaatgccaacggtgacccagcctgagctccccacctgccaaggtccgagttgagctctcagaacccttggcctttccgcagggcctccgagggcgtctggtggatcctgtgcgtgctctgcggcaccccctctaggctttccccactcactggaggccccagcctggcttcagagggactcagtggggcttgaccacgtcccagctgcgtgaccttgagcaggttccttgacctctctgggcctcggctttctcactctgtaaaatgggcacaaacaaggctttgtgaggatgagtgtggctgtcgtgcctgtgagtgcttatgtgattctcactcctgccccaggtcccctccagctcctcccttttgcggtcccgaggtctagcctaagtcccccttgcttctcttgcagggtgtttatttctctcggcttcttcctctccctacgctctcactttgttttatttcatctccgtccctctgccctccccttttcgctatcggtttcaattctccgctgaaacctctgaggaggccctgcccgccccactgtcccgccggccctccccgcagcacccaccctgcccggcttctccggggcttgccctcctgtagcccaggagttggggctgggggcggctgtgctgacatcactggcgtttatgcactgctccttgcccaacgcaaatctcatcctcgttctctctgaatcaattcacttttattgcctcagctgctcaaaagcaatttttcaagaacaaaaaggtcagcacgtccaagactaatcaattctcggagagctcctgccgctgccaggggagccgggctccagcagccccccgcccttcccgccagcccctcccaccagccccatcacttttattgcttcatgatgcctgtcattagtggtgtgtttgagacgccccacggtgttcttacaacataaaacctgggtgacttgcagcgggggtggggtcgggcgcatttatgggccctcgccggctccggacagtaagagctgagctgatggatcgcctgccaggggagccagcacaggaggccttcagccacttgcttacaagcagagccggggctgcctgcctgctcccaggcccacccctctcttcccctcaactccccatcactgtggccttggcatcggccagccgttatgccttccaggaatttgccctcaaggcctcactggtccccaccacagccctacccctccctgggcgtcgcccgcccccccccactctgcccgccacgatgccaggctcagtccctccagcactgtgaggtctacattgccattccacagatggggaaactgaagcccaatgtcacggaggtaggaaggggcagacgtagacttggaaggattctgtggcctgttcgaggttccgtgcatgagccgtgctccgtggagagccaggtctaccgttccagcctttgctctcccaggcccctggctgtccatgtcccacaccaccctgacacctgatacttgacacccgtgtcaccaacagctacagtgcaccacggccttggaacaccgcactcagtgctctgcctggatgagccctgtacccccatgacgaccccactgtggacattcttatgtccattttacagatgacgaaactgagacgggcggatgcagtgttgtgcacaagccacacagctggaaacgtgggctggggactggaacccaattacccgctttggctctataatcctctttttatttttatttaatttttttatgagatggagtgtagctctgtcgcacaggctggagtgcagtgacacgatctcagctcactgtaacctctgcctctcgggttcaacccattcttgtgtctcagcctcccaagaagctgggattacagttgtgtgtcaccacgcctggctaattttttgtatttttagtagagatggggtttccccatgttggtcaggctggtctcggactcctgacctcaggtgatctgcccacctctacctcccaaagtgctgggattacaggcatgagccaccgtgcccggccctttaatcctctttttaaaacaccttaggatatgatatatccagaataggcaaatccatagacacagaatgcagatccgtgtgccagtggctagggggtgaagaggaactgctgaatgagcgggcgtttcctcctggggtgaccagcatgttctgcgactgcagatgatggctgtgccaccttgtgagggtactaaatgccgccgaatggtacaccttaaactggttgattttatgttatatgaacttcccttccatacattatttgaggctgggcacggtggctcacacctgttatcccaacacttttggaggccgagatgggtggatcatctgaggtcaggagtttgagaccagcctgaccaaaatggtgaaaccccgtctctactaaaaatacaaaaaaattagctgggtgtggtggcgcatgcctgtaatcccagctactcaggaggctgaggcaggataatcgcttgaatccgggaggcagagattgcagtgggcctagatcgtgccattgtactcctgcctaggtgacagagcaagactccgcctcaaaaataaaaaataaaaaataaattatttggaaaaaaaaccagcttaggtttttctgccacctgtttggcaagagtctgggtgtccccacaggccgtcttcagctgttctcctaatgcggtctgtgtgctagcaggagagacgtcgagacatcctctgcccagcaggagcgtccgtcacctctcccaggaaacattcctggctgtccccaccagctccaaagtctccacctctcaaacaccatgtcttctttggtgtctgggacacaggctgttcttggccaggccacagcctcatcatgcatggctctgcccggtggctcacgggctctgtccacaacaccgggggacaggtgctcttatctctcccaggagtcaggatgagacgtgcatgcatgtattgccagcttctcttgggatcctgggtgcttcctcagcccttggccgtcccttggcctgggctccccacctctctggcacccaagactggtggaaaaggaaagccctctcgttctgagttgagatctcagaacccttggcctttctgcagggcctccaaaggcgtctggtggaccctgcacctgctctgcagcgccccctccaggccttcttgcacgggacagtgacagggagttctgtctcagagcgagtccagcagggcctccacagagtgcaaggttgcctgccctgcctgtggaagagcaagccttgtcccctgtttcccagaccccctactcagtggcctctgaatgtccccaatgtgggcccctccctggctgcccctcttgctctccaagtccgagcccacccagagcccaagccctcggaggcccctgccacctggaaagatgacactggggcagggttctcttctgatgtctgtgttttgtcttgtgggccttggggtgcccctgcccctgataagaaggggtttcagagcagaaataaagcctcagacaggtgagcctctgtggcacatggcccctcgagccagccatgcatctgggttcagcccctgccaggacacttgaccaggccccttaccttctccgagctgggatcatgctgggaagactgaatgggacgcagccggtgaaaacgcctggaagagagtaaacgccattttctctaagcatatttatttctttaacaacagtgacgaccatttgtgagccatctctctgtctcaggcacggtgctacatgccaacgaaacctgctcccattgaaccctggccagccagtgaagaaagggttgggcctgggaggtgccactttacagacaggggcaccaaggggcagggtggcaggaggcccaccggacgttccccatgaagtagcagtaccagcatccacacccagcaggcaccacgctggcccgcagcctccctgccagcacgcctggcttcccggcctcggaacttgatctgctccctcttccggacactggggctcctgccaagtcctgggctgggcagcaactgctgaacattctaagaaatccctcccagggttttctcaggagcccgggtggggcaggaagtccccaggggctgaggggaccgtggcggcaggtggcacccagagcagcactctcctggggcccaggctgttgggccagaggcaggactgtgaggcctagtgtagggcctcctgccagtggccggcacctacttgtggggctgggggttcccccagcaggttgggctccccacctgacacactcacagaccttgtgccttggagagccagtgttcccggggccacatagctatgccgcccaggggctgggcctgtcccagctctggtcccccggccccaggtcctggacgctggctccgcgcagcagcaggcggcctccggaggacacgatgtgactggctgccgctacgtcgcactcagatgagtctgcgccggatcgacctgctgccgagtcctgccggacaggcacaggcagggagtgaaaattatctacccctttttatttcttaataactgaatgaaaataaacattggtggtttgacaaataactacatattttcaaacccagccagtccaggggatgcagtttccaggtgcgttatgcaacaggacgccgccgagatgctctgagatgtcccttggctgtctcacgggttgtctctgggttccctcccacccccactctcctttgccaccctctccccagcccccactaccctttcacgcttctaaattcaagggccacactgtcccctgaacagaccaatcacaatgagatccattatagttccaaagataccacgaaaaaaaaaaaaaaacgtggggggtgtccaggaatgcagccgcaccccagagagcagtacaatcagctattgttgtgctagaagtttctctgtgataagaagggaatctagcaatgccgccttctgaactgattgcaaaacagaatagaaagttcaaggccccgagatagctaagctagcagcccctccagagcagccccaggccacacagctgggctttggggctggccagcccctgtccttgcatgcatctgcacagggctccttgcaagggggcccggctccatatcccccacctcgccccctccccatctgggcctggggcggctgagctggcttcctgcactgaggggaccctccggcctccttcctgaagcagctgcccttccccgagggactcccgggtgagggcctcccacattgtctgctttagtgatgctggttctcccacagacgctgcctgtccaccccgcacagatggcatgactgtcctccccttgcccgggcagggatacggcggcacagagatgggggccgatggctaggacctgaactccaagctgtgggccccaggtttttcatctgcttaggccactccccactgcccagacgtcccctggggtgtccggtttgctggaagggccaccactggccttgagctcccagtgtcatttccgggcgctgacgcgtgagggtctccaacaggcgggcccacgggaagtgctttctgtgcttggcccttcatgctttgcctctggttcctgaaatgggcactggaggtgggcacagttactgtccacatttcacaggtgagcaaagtgaggcttagagaagctaagtgacttgtccaaggtcacacagcaaaagaggggcctcgaacagaactaaagggcccatggtgcacaggcagaggttgccatagagcgaccagggccttctcaaatccggctgtgagcagaaacttctcccgcccccccgggcccaccatggtgacctgtggagtgcctccatgcgccgagatcgcttatcagcccatcagcactggtcacggccacttttatggtctgtgttctctcgtgtgtctgtattcgtgcgacgttccttcattcaggcaatatttgctgagcatccaggaggcccccgtttattcatttatcatccagcaaacaccgcgaggcggctgccagctggggccgggctcggtgcgggctcccgggtgggggcgggcatcacggggcactgcgtggcggatgtggggagggtcgtgatggggagggacgtgctaggtgtgcacagagatgctggggtgcaggagcgggtgtctctctgagcacatggcccggaaactgagggctgtgggtgcactaatgtgggggagagaccaacttcctttcactggagccctcaaagtttctggcagggataaccaggatcctagcgtctgacactaagttcagggaggtcacaggacgtgctggaaccaggagttcagggttcaagcccaggcctttctcctcatattgaacgggcctctcctggtaccatggggtgcccttgatccaaagcccccagtgaggaacatctcacggtatgtggggatgggcctttgccatagcagcccatgcaaggccttggggccagagccagccccgcagggaccctccttgcactattcttcacatacaccattgaggacaagaggaagggacacccctggcctggccatgtggtgacagctccctgtgcattgacccccaggggtgctgcgatctaggagtggccatgagacgagggggagggagacactttcccgatggtgtggcgggcaggtctggcaggcagggttaggcggggtcgtggaagaggctgtcctggcccagaggctgccaggcctggcctggggctggctcctcttccaggaaaggtgtgaggcctcttgtggctcagcactttggaaagtcagccaagttctaagcttacaggtgcatgaaggttccatgtctgtggtttcaagaacataaaagtggggtgggaggccctgggaggtggtcctgtgtgggggcagccaagtagggggcgtgggatggggaatgaggtaggggatggagtaagatgtgggagaagtgaagtgggggtgaaatggggaagtgggagtgggaggggaggaaggggcaggtgctgggaagttggcccttgtggccctaatctgtctgtgacagcttccgctcctacccatccacagggacaagaacaagtatccccttccccagcctgctccctcttaaaaaaaaatcctcttcctatttagtatgcaacaggtgctcaatgtgtgctcctaccgttctccaggaaaggagggagctaagcaggacacagcccagagctcagcactcccctagcctcccaccctcacctcccaaggcaagggccaaacccaacggtctggctggggacccccaccagcctcccccaccatggatggaggtggcacgtcttgaggcccagagggggcagacatgacgtccaaggctacacagtgagtctagaccacatggcctgctcctcacgccctggagaaagaaaaggcagcccaaagcagggagggtcatgccccacctggagtgggccttgatgaccttgacgtccccttcccaccttgaaatatttaacaattcttccggagtttccccaaggaggcctattcacacaggcgggccatctgatgatctgcccctggggggtttctcctgcagccacctgggaggggcgtggcactggacagggaggtccctttaccccacacaagaaggaagagccgagtaacccaccctgacgggcagtccctccactgggagctggggccagggtctgggcgaggggctggagtcagactgtgggagcacggagcccaggatctgagcctgcccgcaggctgcctgtcttctggtctctctcctcctgctccagcttggccgagccaagctgccgaaggccaaagagcagcatgaactcctaagagtgacccaaataaaccttcttttcaagaaaaacaggccctgcaagcctgtgggtccccatgacaagggatccatcaggcagacagactgcacttcggttcggttggtgaggactctgtcccactccgccagcagctcccagcctgctgggccctggccctggtggtcaccgctgtggcttcctgcacccccgccccgtagagagctgcagggagcccggggtgctgctgctcttctgaggcgggagggtctcctgcctttgctcaggttttatagagagagggtgggctggacagggacagacaggggctggcggctgagggtgagggtggagggagtggtgcggtgtcccggctacaggcgggctctagggctgggctgggtgagggcttgggcagggtgggtggaaggctcagaggggcctggggccagggcccggtgggtccttcgctgccctggttggggtggggtgggtcactgcagggaattacagcaagtgggaggctccaggaggtggggagtttcctccgacttttgggactctgaggctcggcctcctcttgcacgttctccagcctcctcgtcaccgccaccaggttactacctttacccgacgcacacctgacgtggctggatgactgggcccgggggctgctgccccttctcgcaccccgcccctcccctcccctcccctctcctctcccctcccctcccctcccctcccctctcctctcctcccctcccctctcctctcctcccctcccctcctctcccctcctctcccctcctctcttctcctctcctctccttctgtgcccgtctccagccctctcccgttctgcgcgcccctccttccccgacttgggcagaaccgcacgcagcggctcggaggccaggcgtgtgccgggcgggatcgcgcgcccgctggggtgaaatcaaaagaaaagcaacaaagccccttccgcggaaaatggggtggatgtgagcggcgccggcctcttcctgctggaatgggaattagcggcgaggattattttgaggacgcgaggtccctttgtgcccaaatgcgcctcctcctgcccggctcggtggggttcgcggcgcacggaccccgcccccaaggcctcaggtgggccgggggctccgggaggcctccgccgccctccgtcccaggagagcagttcccggtgagaagcccgggctctgcagacaccccacagcagttctgcgtctcggaaaacgcggcgccttcatcaggaccg

SEQ ID NO: 496 - DNA, 25933 bp, Homo sapiens
gattggcatcagacatcctaccagctgcaattgcatcatttttacctatcatctgcttttccttttgcgggggggtagggttgggctcttataaacgggtcaaagagacttcaacctcaaaaccaaggagaaatccctgcttgcagagaaacacaggaaatgactctttctctgtgaaaggcagtcaggaactctgctccggtgatgagggctaactgatggtgtgggagagtgatcaggaagagaatcttcctggaggtggcacaaagtcagcaagagcccaggaaatcacactcctgggatggctgctgtcaccaccatcaccctctcttctgtctcccctcggtgccatcaaattgagtgaggaacaagggaaagtaactacatgaagaaaaccaaagtgaacatgaatgtgggtgatgtgaatataaaaggagaaactaaaaatgatcaaaagtttctcccgccctgtggtggaaatctctgatccatgtcttcatgtgtctaacttccaaggagggggctaacagcacagacatggaacaaaaggcccatgttggctcagagatctaaacggtgggcccctctgagatggtaactgcaaccaaggtgtctgtgatgtccttggttactccacctcctgaccaggggtctagtttgccattgctgaaaatgatgtccatgtgcgaactcatgtttttgcctccacacaccgtagtgatccaggagggcctctgtctcacaccccactgtttaaaacagttatcagaaaactccttcaagttccacgagtgaagttcagacaaaaaacgctataaaaagttagatgcataaggatagctcaccactgcacgtcacccagtcttcagaggtctagtctttcaaatgtcgaatgtcaggaagccattgcaaactaccgtccatatttgagagtcgattaatggcatctcaggacctacggaggttctctgaacaatatggaccacctttcttaaaatctgtagttacgatcttcataaatacaccacaaggtaccaaatccttaaactgccagataagggcagaagttgcaagagctccaactaccatatgagggtatttcattctgaactaggctgcaagcatgccaccataggggccctagagggccgtgacagggtgattttcagctcctaggactgttcttttcaagtgtttgattagctctgcaaaatcagccagaccttgctctgatgtcaggagatccaagtgtccagaatccttgaatgggtcatcacagggcagggactctccgcagtatcgctgttccgcatacaccaacatagctttcagttcctcagccccatcccacatgaaccacgtattactgcagaaccagatgatgtccccgtcatatttctttcagtatttatttgctattagatactgctgttaaacagttttcacagtatgaaatccaaaatgatcaaccctctgttggaagtggagaaccgagttgttcttggcaacagccgggtgggacgtggagttggctggcgagtgcaggctgccgagagcccttaaggctggctggagggctgtggtggtccagggcaccaggaaagccaggagcaggagcaggagcaggaggcccatggctcaggctggtggctctggtgcaggtctaaagccatgttaaatcaatgttttctctatttaaaaagtaattttctagtttcgaggctgagtttaagagcagagtatttttctctgagtaagcccttagacaacaaagtatcaccagataaaagttaaacaaaagcaaactcaacagctgccttccacctagagccagggagggagtggacagcccctagactggggagaatatagggcagctttatggaaagcggggctgggaaatgtcttagatggcttgggctgctataacaaaataccatagactgagtggctttaacaacagaaatttatttctcatagttctagaggcggaagtccaagatgaaggttctggctgatgtggttcctggagagggactgcttcctggcttgcagatggccaccatctcactctgtccccgcatgcagaggacaggggatctggtgtctcttactcttcttataagaacactaataccatcctcatgacctcatctaaacctaattacctcctaaaggccccacctcctaatattatcccattgggaattagcgtttcaacatataaatttgagggggacacaaatatttagtctatagcaagggagaattccaccagcagatgttgggctgtgcacaaaaatagtccaggctgggccaggtgcagtggctcatgcctgtaatcccagcactttgggaggctgaggctggtggatcacctgagatcaggagttcaagaccagctgggccaacatggtgaaaccccatctctactaaaaatacaaaaaattagccgggcatggtggcaggtacctgtaattccagctactctggagactgaggcaggagaatcacttgaacccaggaggcaaagttgcagtaagccaagattgtgccattgcactccagcctgggcaacaagtgcaaaactccatctcaaaaaaaaaaaaaaaaagtccaggtttgggaggcccaagagctgcttcctctgcgagtctagctgggagcagtcatggctgtgatgaggagaagctgggcacttggggctggcccacacatgcacacataaaccacagtcagattgcatcactaacagccattcacacgcctttaattcagacctagcatttgaacctaaaatcaaactactgcactattacatgttgcaccatcttgtatacaaggagacttcaaaaagctcatggaaaactacaattaacagattaaaataaaaaatataaactttctcaatataggctccatcaagttcaagacacttttgtaagtgatattagccatctagtcaaccctcagagaactgagggtcctgggaatttaaccatgtcaatacagtcatttttacatttattaactgaagaaaaatgagtgccctttaagaattttttaagattaagatataaaatggggccaaatcaggactataaggtggatgcctaatgatttcccactgaaacactcaccaaattacccttgtttgatgagaggaatgagcaggagcattgttatgatggagaaggactctctagtgaagctttcctgggcatttttctactaaagctttagctaactttctcaaaacacattcaaaataagcatatactattgttctttggccctccagaaagtcaactgacaaaataccttgagcatcccaaaagactgttgccatgatccttgctcctgactggtccactgttgctttgactggaccacttccacttcttggtagccagtgcttagattgtgctttgtcttcaggatcatactgtaaagccacgttccatctcctgttacaattgttacaattcttcaaagaaatgcttcaggatcttgatccccttgtttaaaattttcattgaaaactctgcttttgtctgcagctgatttgggtgcaacagtttcagcagccatcagtggaaagttttctcaagtttaatttttcagtcagaattatgtaagctgaaccaattgagatgtgtatgatgttggatactttttctgttgttaatcattggtcctcctcaattagggcatggataagatgaattttttcctcaaaaattgatgtggatggtctgctgctgtgggcttcatcttccatatcatcttgttccttcttaaaatgagctatctgttcataaactgctgacttcttcggagtatcattcctataacgttttcataaagcatcaatgatttcaccgtccttcctacccaagaatcaccgtaaatttgatgtttgttcttgcttcagttttagcagaattcatgttgctctgataggggttcttttcaaaatgatgaaaccattcttagtgcctcaaactagatcccgttcagacacgttataacaagttagtacgagtttattttggtgcaaaaaatggaaaccatagtttccatttccgtttccaatgcatagttctttcattatatgcattttccatgagctttttgaagacccctcatatagcttgtggcctacagttaagttgagccactttaagggctagtctgaagaccaaaaggaagaagtcatgaaataaggcaacatttgattggatactcaggactcacaaggggaatttccctggcatcccctttgtcgtagtaaaaatagcaaaatataagacagcactaattactgcaacatgctaatgtatattcgaggatagataaacattgcaattttaaaagggtgacatagaatataagatttgtttcctttctcctagaagattgcagacccaaaaataaaattttagaaagtgctccagaagagttcctcgaattcaaggatagctttcatgatcacatatttaaaatatttattgaccacgtactatgttctggaccctgtggtagtttctgaggttatgtcactgaacaagacagacattgtctctaccttcaccatgcataatctagtggagaaggcaccaacacttgcacaatttatgctgtcatacaagtgctgtgaaggagaatgtgactgctatgagactgaaattgtcttcgttcgtttagtgttgctataacagaatatggactttgtcttaagtctgtttagtattgctataacagactacccagggctgagttatttataaagaagagagatttatttggttcacagttgcagtggctagaaagccagagggcttggcgctggcatctgcttggcttctggtgaggcttgtgttgcatcacaggatggaaaagaagcagaaggggaagcaggcatgtgcagagagacaaagcaagagaagcaacatggatttgtaacaacctattcttgcgagaactaatccattcctgagaaaactcacctgctctcttgagaaagacatcaattcatcttaatgacttagtcacctcttaaaggcaccatctcccaacattatgatattggcaattacatttcagcatgagttttgctggggactctcaaaccatagcaaacatcatggggtcctatgtaaatgggaatgtggtgtaggagtagggaatcagagataattttttaaataagtgatttaatggagattcaaaggataaagaagggttatctgaatgtagaggagaataaagaaggatactggggagcagaggaagcagcaagggcaaaggcctatgggcaaggagtgaaagaatgcccaaggggctggaatggcaggaacaaaagctaaccggggaagaactagtttacccagggtcttagaggccaagttaaagattttgttcccatcctggatgcaatagaaagtgcacccactggagtgtttgaaacagggggagtgacagttgttaggaataacgcttaaaatcttaaggaaattgaacactcgaacaaaggatttttagcaaagcaattttacttttgcgtagaggggtgcctctttggccagttgccatgagagcacacttgaacaaaggggcacaagagcctttacttttgacacaagtcttgcccctgtaccctctccccattggctggggtcgggttgtataatttaaactaatctcggttggctaaacatttgattttttttttttagaaagggtgggcacataaaagaaagtggagatgaaggggaaaaggggtgtctgtaatgagctagaaggttggtcttttttttaaataaggaaaggaacgcgagctggtattgataactcctggtattgtggcatgcttgggcatttaacaaaggcaaaaaggaagaaaggagaaaaaaaagagagggtactatgaattaaagaataaaatatcgatcagattattttaagagaaacctcatcatatcccacatactgaagggcaagaatgaatatgaggaaagtcgtcaggaggcaagagacaacaggggcctggactggggtgctggtcatgaagatggacagaaagagatggactcgtggtatgttttgaatatataatcaacaggacttagtaaagacttggacgtgggacatgaagaaggtgtcaaagatgactctccatgtggtgttcaacttgagcaactctacagatattgaccatttaccacaggggctttggaggaagggtgaatttggaggggaaatggtgagtccagttagaattccaaggatgactttggacaaaaaggagaggtctgatttgaaggtacacatttgggaatcaaatgaataggatccactaaggagagagcacagagaaatagaaagcccaggactgcaccccgaagaatgccaggatttataggttgggtgggggaggatgaggcagcaaaggaagctgtgtagtggtcactgaaacaggagacaaactaggagaagaggatgtttgtggcaagtgatggaagagaatattttaggaaggtgatgatcaacactattgaatgttgctgccaagctgagaaggaccaagatgtctctgttgttgttagcaattcccatgcccttccttgggtgaggcagattttctgggttgtgagatagaagatagtatgcagtgggttgaaatataactggaaagtgagaaaatgtgactttaatggggagaagaagtatggtgtggagctggagacaatggggcattgaaggacggatactaaagatggaagtgacttgattgggtttccactgctgattagaaggatctattatttgacaggaggagattcaagatagctccactgggaaggtcaaatgggatggatttagagccatctcttaaaggcgccatcgccctgggtttagagcccaggagtgaaaggctgactggacattctgtacttggggaatgtggtggggaggtgggtgggagttgttgactgttaacttctcagtagggtaatctggctgggccgtgtgctgggggacccctgacatcagtactttcaggtttctcttcctgggccatctaattcccctgaggagaagcttccagcatcttgcctagagggagaagatctgcctgcctacattctgagagatgagtgagaggaggggctgcccaccacagcttccagcagacataactcatttcattctcttgtgcttttaggagccttaccttccgttatacctaatgttctcagtcctgagactctctgctttctccacagacttcatctccagtctcctgatggggttggggagaagcagtggtggagtggggttggggaaactgcagagccaattgctttaccttcacttccagaagtgccttcttgagctgtttgcgcgtgctgtgatggaaatcacgttaagctcagctttctgcactgccagatttgtttttcatcagttttccaacttccagaacctccttgttcgctctcctgttccctcctgttctctctttactgtggtttggtaggacttcaggagaggtcagaattagatgcaggtattcaatctgccatctttatccagcagtcagtgtcaaagcctgtctcgattgtggaggaatatataagaaaggaaaaggccccagtgtcctgtcccttctgatgctgtgtggataccaacaccccaaacaatgccacccacccagctgtgtcaaaccaaaccaaccaaaacaatgagcacacatagatggcaaactgcagggtttgccgaggctcaggcaattcgtatttggaatttgccacatagatggcaaattgccgaggctcaggcaattcgtatttggaattattaatatatggacccaaagccttcaacccactacatcggccaccaaagacaaaatgagataaaattaggaacatgttcatcttcctactataatgattaataaaaggccctttaagttcagagaaatgatttcttctttttcgacgcctacgaagaaatttcattaaaaatattaacagaaatccaaataaaagagaaaaagaaccttatcgtaatcctatctgctcaacacgtggtttggtttgatttggtttgtttttttccaggttctcaaccagttgtggtccatagacattcataatttgacaaaaaggatctatgtcaactctgattagtttgtgaaagtgggcttttccccaaatccttccagtgcctaagctgggcccctttgggaagagcattaactgttttgggtcactagcacacagaacagtgttttaattgtctaaaaccagggataagagtataatcccctccttataaggcaccccgtggtcaggtgcttaagcacatgagggaggcagacaccgctctggggatgatttgcaggttggagagaacctggctccagatttttcctttcaatcagccacagggcctagcttccccccgagaagtctctttttggaagttgaagacattgtgtctcatagcagtactgacccggagggttaggaagaatcttcgaggccctctggccagcacccctgatgagtggctgtctgtcctctgctgcacacttccatggcttggaaactcactactggaaggctccagtgactttcggacacatatctgggactaactacagttgacacttgaataccatggaggttaggggcactgaacctcccccaccccttgcacagtcagaaatctctgtataacttttggctctccgaaaatataactactaatagcttgctgttgactggaagccttactgataacataaacagttgattggttagcacatattttgtacggtacacacacgcacacagacacacacacacacagagtattcttacaataaagtcagctagagaaaagaaaatgtttctaagaaaatcctaaggaagagaaaatatattaactatccattaagtggaagcagatcatcataaaggtcttcatcctcattttcttcacgttgagtaggctgaggaggaggagggattggtcttgctttctcggggtggcaaaggtggaagaaaatctgagcataagcaggcctgtacagttcaaacctgtgatgtttaagtgtcggttgtgattcattaagcccttagtccccctcccaccccccgcctttacagttttgagcagggagcatggccaagagaggccaggctggactgggcactgcagtggggattggggatacccagatggagcttgggttccgagtgggcttctggaaccaatcccccacagataccaaaggaacaacacacatgcatatacacacacgtgtatatgtatacttatatatacacacacatatatatccatatatacacatacatatatgcatgcatacacatacatacatatatacatacatatatacccacatatacacatacatatatatacacatacatatatacacatgcatatatgcacatacatgcctatacatatatgcccatacacatatgaacatacatgcccatacatatatacacatacacatatgcacattatatatacacatacatatatacccatatatacaaacacatatatgcatacatatacatacatatatacatacatacccatatatacacacatatatatgcatacatatacatacatatatacatacatatatacccatatatacccatacatatatacacatacctatatatacccatacatatctacacatacatatatacacccatacatatatacacatacatatatatacccatatacgtatatatgctacatcttatcatatattatatattttatataacataatatgtattatacccatatacacatatatatgtgttatgtattatacccatatacacatatatacgggtataatacatattatgcaatataaaatatatatatgcccatacatatatacacccatacatatatacccatacatatatacacatacatatatatacccatacatatatacacatacatatatatatccgtacatatatacccatacatatatacccatatatatacacatacatatatatacccatacatatatacacatacatatatatacccatatatattatatacacatacatatataatacccatatatacatatatattttatataacataatatgtattatacccatatacacatatgttatatacccatatacacatatatgggtataatacacatacacatatgttatatacccatatacacatatgttatatacctatatacacatatataggtataatacttagtatgttatataaaatatatatgtgtatatggatattatatatgtatgtgtatataatatatatgggtatatatatgtaggtgtatatggttatatgtatgggtatatatgtgtgggtatatatatgtatgtgtatatatgtatgggtgtatatatgtatgggtatatatgtatggctatataagtatgagtatatatttatgggtatatatgtatgtgtatatatgtatacatatacacatttattgtttatgcatacatatgtgtgcatatgtgtatgcatatacacgtgtatatgcatacatatatatgtatgtgtatatgtatgcatatacacatgtgtatgtatatgtatgcatatacacatgtgtatgtatatgtatgcatatacacatgtgtatgtatatgtatgtgtatatgggtttatatatgggtatatatatgtatgtgtatatatgtatacaaatacatacccatatatacccatacatatataggtgtatatatgtatatatatgtatatgtatatatgtatggtgtatatatatgtatgtgtatatatatgtatatgtatgcatatatgtatgtgtatatatgggtatatatgtacgtatatataatgtggatatatgcatgtgtatacatgtatgtgtgtatatacgtgtgtgtatgcatgtaaacacatatatacaagtgtaaatacacatatgtacacatgtgtattatacacataggtacacatgtgtataatacacatatatccacattatatgtgtgtctatatatgaacatatacgtgtatccagacagtgtgtacatatatgtgtgtatatgcatatacagtcatcacttggactcgtgggggattggttccagtagcctccgcccatgcctagatcccacaggatgaagtccctgatataaaatgttatagcatttgcatacaaactatgcacatcctcccaaatatcttaaatactttaaatgatctttagattatttataataccttatacaatgtaaatagttgttatactgtattgtttagagaataatgacaagaaaaatatctgtacatgttccatacagacactttttttttcaaacatttttgctccatggttggttgaatccaggcatgtggaacccatagatagagaggggctggccaggcgcagtggctcatgcctgtaaccccagcattttgggaggctgaggtgggcagatcacttgaggtcaggaattcgagaccagcctggccaacatggtgaaaccctgtctctactaaaaatacaaaaagttaactgtgtgtggtggcacgtgcctgtaataccggctactcagaggctgaggcaggagaactgcttgaactcgggaggcagaggttgcagtgagccgagaccatgcactgcaccccagcctggtgacaaagctacactccatctgaaaaaaaaaaaaaaaagatagagagggcctagtgagcacgtttgtgtgtatatggtctcaacatcagaacaacctcagatctagcattattcttactttggaaacaggttgagagtcagagaattgaacaactttcccaaggttttgtagcctgtaaatggcagaaccaggattgaatataaaatttctaaatccagagactttgttcctttctacactggcatccaaggtagtcctctgagacatatgtaactgctatgcttgaaacctgcatttccttccacatggcatcacactctccttagacactaggcttcacgtcacgtccagtttctaagatcctcacggttctatgtctgtttggcagcagggtcatctgagaaggcctgcagtgtgggccagcacttcacaaaccttcatgtgcgtgtgaagcctgtggtctgaatgcagattctgattcaggagtctggggtggggcctgggactctgcctttctcacaattgcccaggtgatgccacagctgctacgggtccccggaccactctttgagtagcaggggcggggcagtgtggcatctcactcttggttttgaatttcatctcagcacaatctggggtcacttatttaactaacgtaacttctctggggctcagaatcctcatctgtgaaatgggaacaataatatcagccccactgaggaatttaaatgaaaggagatgatacataacacagatcagcttctcacttgttttggttagaattggaggtgattccttcattgacataaaacacgaggctgttatccagacagagctgttaaactttgggttgggttccaaatcatttgggttataatgtcagctctccgcatcactccagaaaagtgatcttagtaagatccttctagtcattttggttgagacttgtttcaggtggtctagaaggcctatttatttatggctatagtttttttgtttgtttgtttgtttggagacgagtctcactctgtccatgctgaagtgtagtggcacaatctcagctcactgcaacctccacctcctggattcaaaagattcttatgcctcagcctcccgagtagctgggattacagctacccgccaccacactcagctaatttttatgtttttagtagagatggggtttcgccatgttggccaggctgttctcgaactcctgacctcaggtgatctgcccacctcaactctaccaaagtgctaggattccaggcgtgagccaccggcccggctgtggctatagttttaaatgctgcctagactccaaattgctgcacacaacctgtccccaagtccgtgtgtgcacatccattatctggggtttcagatgtctggggtttctatgtcttaggagttgccccctaagtgtgggagtccaaactttccctacgacagaactggaaaaaaacaaaagcaaaaacaaaagaaagctagttccacttttatccagagagaaccgaaagataggatcacatttcctcaaacttctagtaaagaagtcaggcacgggtctgggctctggagcctggagccagctgtagggccggccggtggcctggaaacaaacagtcccacataggccgggaggaatatgcgcgcactgcctgcctccattgttttctttcctggaatagctgcttgttctcatcagctagtgtggtcagcatttccattcaagatcatattgtcagggctttatttttaagtcaggcatgaaaatgggccttgagctgaaacttggaagctgggcaattagcatatttgaaaggaagccaactggtcttttgttattccgtggggcagaaggggcttttccatgctcttctaaatgacaaaaagggtttgtgtttggggcattttaaaacgaagcagtaggcatggacttggctgtttacacacagaagctcacaagaacattgtctctgggctgcctggatgatgtctgtaggggctgcgagaccccaaggatgttctctgctgaccagaggaactggagcactttaatgtagaaattggaagccaaggaactttgtgtttaaagtagaactgctggaagtggccaagtccacggctgctttccagaatgcccttaaagaaaatgctgacccgccaactggcaaatacgtcctgagtgccttctccccacgaggcactagtttggcagaaatttggagctgggctgggcagtgatatggaaagaagtatgcagtctaagtaggagggtcatctgtatctagagagataaaaacacaaggttagttaatgcctcttgctgcaagaggaaccagacgtgaaagggatagggaagcccaggaggggagggaccatgaaggattgagaaagattgctgcgtacgtgttaggggggtagggagggcaggtggaaagaacgatggctttggaacccctgactcactgtgtgacactggcaaatttctgggccttggggaagtaccagaaattataagaaaactaggaaaaatagtaccaggacagagctgctgtggaattgtttaatgagataatgcatgtcaagtgttcagcacatagcaaatggtaattaccgtgtttaaatgatgggtatattggtttttggagttaaataatctgagcaaacggatctggtcagaaatccttgaaggtccggggagccggtgggatgagtctggtgcactgattccatagcacaggggcaggaccctctgtaatccccccgccccccattttgtgcacactaaacacataattgctggctaagtttttcataatgtacataaacaggacaaacgtattttccctatatttcagatgtagagatcaatataagtagtggtgtcagatgaatcataggctgtcccaatggggcatatttttattaaaaattatttatactaaaaagttgttggtttttatctgaaattcaatttaaccgggtgtcctgtagagagagagagagtgtgtgtgtatgtgtgtttgtgcgtgtatgtgtgtgtgtgcatccacgcacgccctaagtctagagaccctattcctaacacctatgtacccaacactcagagttaataagtatcaatactttgctatcttaccttgagttttttaatgttttaaagagaaagttacagaccacagttggaatctccttgtcacacacataccaacatcattcttctccaaaaatgcccaaaattgattctattcgtgtgtatccttatgtggctgttctactttttctatatgtgtatgtttccagaaacaaaatacactcttgttttctgtgctttatagatttacataaatgatatcttagtgtatttttctttcagccatataattttattttaaacatgaaatttttgataaaaaatattatatgtgatatacacattgtcatcaccataatacagccaacgcctgtgcatccattacccagcagaagtgccgtccattacccagctgatgtgctgtccattacccagtggaagtgccgtccattacccagcagaagtagaacgtcgccaacgcttttgaagtctctgtgcctccttctgaattgcattccccctgaccccacatagaaggtaactgcctccatgagtggagtgcttattctttatatttctttgtatttatttattgatttttatttatttatttttgagacaggatctcactctgtcgcccaggctggagtgcagtggcacaagctctgcccactgcaccctcgacctcccaggctcaggcagtcctcccacctcagcctccccagcagctgggactacaggagtgtgccagcatacccggctaatttttgtatttcgtgtagacacagggtttcaccacgtttcccaggctggtcttgaattcctgggctcaagcgatccatctgcctcagcctcggcctcccagagtgctgggattacggatgtgagccaccgtgcctggcctttctttatagtttatcataatatatgtaattctgaatgacagtgctcagttttgagtgagtttaaaccatgaacggaagagaacattgtgctgtttatgttcttctggagctatgctctcttgacttcatatatttaagaggttcatttcgtgttggtgagtgtaactatggttcattgtttcttttcactgctgtttactattctattggataaacacactgcatcttgtattgctacgggacatttgagttgcttcaagtttttgctactacaaacacagctgttatgaacattattatacttttttctggtatatatatatatatatatatatatatatatatatatatatatataaaataatttgtctgtggtaaaaatacctgagtgggatctctgggtccttgtattattaccatcatttctcaaagtggttctacaagtttataccctcaccagagtcttgaccagtttctacctctaccagaagcgtataagtgtcttgggtgtttcacagtccctcccacacctgccaagctcctggggacaaaatgatgtcttgctatggcctaaattgtctttgccagattattaatgatattgatcatcttttcatataagtattggccactttcagctccttttctgtgaagagactgttccggtcatctgtttatttttctattgggtttgtcttttttcttatagatttgtaagaactcttcatatattcttgttactaaccctttgttggttacatatgttgaaaatattgacttttagtttgtggcctgccttttcattttttatgatatcttttgaggaagaaacagtcttaattttaatgttgtcaaatgtatcagtcatttgcttttctggttaccactttgggtgttaagaaaatttccttctttccttccttccttccttccttccttccttccttccttccttccttccttccttccttcctttcttctttcttttccttccttccttccttccttcctttcttctttcttttccttctttccttcctttctttctttccttctttctttttcaaggtcttactctatcacccaggctggagtgcagtggcacaaccacggctcgctgtaggctccaactcctgggctcaagtgatcctcctgcctcagcctcctgagcagctgggactacaggcatgtgccaccatgcctagccaattttaaaattttttcgtagagataaattgtttttgctatgtagcccaggcttgtcttgaactcctagccttaagcaatctccctggcttggcctcccaaagtgttgagattacaggagtgagccacagtacccagccaagaaaactttctttatgctggcattataaaaatattcttttatatttttctcttagagttataaaggtcagctttgttatttaagcatttaatctacctgaaattgattgttgtatatggagtaaggcagtgatccagttctgttcttttaccttatggataaccaattgttccagtgtcatttactgggaagtctatctttttcatcgatctacagtgccattcttttccatacatgcatggctttatttctaggtttcttttgttccatcagtctgtctgtctatccctgagagttccatactgtcttaatgactatagctttataacaagttttaatgtctggagaaacaagagttactaacttcttcacagcatcttatctattctcagtttttaacttacaatataatttttgatgcaacaaacttttataggatttgtctatgtaagtatatattatttgtcattaatttaactgccatttatttgtatttacattatacatatgtattccatttataaatgccacagttgactgtccattgccccactaatggacattaagtggtttcccactttttccttagcacctattagaggaattgttggattatagagtatgtgcatcttcaaatttactatataatgcaaaattgctttccaaagtgtttaaaccagttacactcccaccagctgcgtaagaattgaagttaatctgtctctgctgaaacactttttatttttttaaaaaaaggaaggatgtgcaatgttatctcagtgatgttatattttcctctttccatatgcgtttttcatatgtgtttattagctatttaatttcctgttcatatcatttgctcatcttcctgttggattgtctctattcttactgatttgctcataagtcattttatattctaattactaaacctttgttgtttatagtggttgaaattatcttctcgaatactgtggatcaggggttggcaaactatggtccttgtttatggcctatttttgcacatcccaaactaattttaatgtaatctaatgtctttacatttttaaagattgcaaagaaagaagaaagcagcagcagcagcagtggcaacagagatgcatgtggcctgcaaagccgaaaatatttatcatctggctattcacaaaaaattgctaaccaccccccgcaacccgctatgactgttttctaacttagtttctatttttgttgtcattgaaatgtttcatttcaatgtagtataatgtatcattttaaagattataatattatagattatatgactctgcttctagctctctgatttcattgttctattcatatatcaaaatgccaataccacttttaaatttactagtgttccaaaataagtctgatatctggtagggcaaatctgtccccttccaacccattttctctcttaaacagttctgatccaacaacctccccacttggtcacaatgaccaaagttgattcaatgcatgcattaattttatatttatacctttcaactgccagtatataaaattcaaagttgtttccgcccctaccccccgccagctgattattgttattgctattcctgaaagggggtatttttcaatccatggcacttgtgtgcattagcaataattagataactttgctcaaaaaatccaactcattttgaagacatctgtttgactttctttgcccttctgctggcttctggtgcaggagctgagctcttaattaattattgcttatatcgggtagtaataccccctgaaaagtgaagcaagcttgcgctaaaggaagcatagaaaacagtacatttctgtaaacagacgacaatgtttactgaatgcttatttctttaaatgtcattgggtatataaaaccaagcttcttggagttctatccactaaactcaccgaatcattccaaattctaacttaatttcagcagtagagatgattcatagcaaagcagaaccaaatgggctgcagttggatttttaggtttctgtagttcgtgttttcaagtttttaaacagctttattaataaatttctttatttgtttgtctgtttatcgggcagactcccaagccagaataggctcagggagactccttaaacagctttactaaggcataatctaccgacttttaaattcgctcattgtaagtgttcaattcaatgatttttcacaaatttacagagttgtgcagctatcaccatgacccagttctagatcattccctttaacccaaaaagttccttcagactggtttgtagtcaattctccccaccccttggcaattgctaatctgctctctgtctctgtcaatttaccctttctggatatttaatataaatggaatcatacaatatgtagcctttgtgtctggcttctttcactctgttttagcagactatttttgaggttcatctatgtatcagtagttttttttcttcctttttattgctgaaaagtgttgaagtcaaataaaatatagagagatgaatttcttttctttttttcttttcttttttttttgagacagagtctcactgtgtcgcctaggctggtgtgcagtggagcaatctcggctcactgcaagctccgccttccaggtttacaccattctcctgcctcagcctcccgagtagctgggactacaggcgtccgccaccacgcttggctaattttttgtatttttagtagagacagggtttcactgtgttagccaggatggtctcaatctcctgacctcgtgatccgcccgcctcagcctcccaaagtgctgggattacaggcatgagcccggccctcgaatttctaaaagtagcattttctttgggaagaaagaattgcaatttgagacatacgcacaaactgggttgtctttggtatgtccagagaacaagaagtttagaggttttattttttaaaaagagatatgttacgtgttgctctttgagaaagttcattggctctactaaggtttcagggagctggcaagctctaaccggtaagtgatggtagtgggtaaaactagtcttagaattgcagcaagttatttcagcagctgtagataaaactggtttcagtttacagcaggcggttttagcaactgggcttgcagagaattacagttttggagagatggtatgtgtccccagggcttttccctcctggtttctcaactctgttttagttgagtacgacaagactttcacaagagtatttcactgtgtgcataagacacactttgtttattcatttaccaattaacagacacttgggttctttctagtattgagctgttatgaatgatactgctctgagtatttgcaaacatgtctatgtgtggacatgtgctttcatttatcttaggtagattactaggagtggaattgctgaatcaagcggttaagtttaactttctaagaaaatgccagacttgtctaaagtggctgcattcttttaaatcttcatcggcaacatgtgatggttaaaatttctccatatgctcatcacacttggtattgtctgttttttgatgatagccatcccagtgagcgtgtagttgtagctcagcatggttttaatttgcatttccctagtaactaatgttgttgaacatcttttcaagagctttttagccatttgtataattttttggtgaaatgtctattcaattcttttgaccatttttatattcggttatttgttttcttatcaatatatgtttggagaactctttatataatttgtatataagtcctttatcagatttgcaaacattttctctgagtatttggcttatctttttattttcttagtggtattttttaaagcatgaatgttttcaattttgatggggtctaatttataaatttttttcttgtatggatcttacttttggtgtcactcataaaaatatatagcctaatctaaggtcagaaaaaattgtcttctatgttttcttctacaagttgaataattttatctcttacatttatgtctatgatccattgtggattaatttttctgtttatgctgtgaaatgagagcctaagttctttctctttttttttttttggcacgtggttattaaattgtcccagcaatgttttttgaaaagataaccctttcatcattgaactgagttttctggaatctttttagaaaatcagttggttgtaaatgtgagggtttgtttctagacttataattccactccactgatctatatatctatccttgtgctaataccatatagtcttaaaaagtgtagttttagagtaagtttcatattgagtaatgtcagtccctaatttgttctcttttaaaaaattgtttggctactccagatcctttgcatttttatatagatatttttaaattaggttatcaattctcacaaaaaaagcttcctgggtgtttgatagggattgtgttaggttaataaatcaatttgggggagaactgccatcatgataatattgaaatccatgtgcacttgggatatctctccatttatttagcttgtttttaatttttctcaacaatgttttgtagttttccacgtatgagtcttgtattttctttactaatttattcctattttattctctgtgaggctattatgaacagaattattttcttaattttatttttaattttcattgctagcatataaaattacaacatttcttttatactgatcttgtgtcagacaaccttgctaaacttgtttatttgttcttattagttttaggaggattctttggcattttctacatacatgactctcaaaaatcatctcttctgagaataaatccagttttacttattcctttccaatctgaatgaccttgttattatcgttttgtttttattgttgttgttattgttttgtttttgactattttcctggctaaaacctccagtacaatgtttaaaaaagtgacaagagccgggtgtggtggctcatgcttgtaatcccagctactcgggaggctgagacaggagaatcacttgaacctgggaggcggaggctgtggtgagctgagatcacaccattgcactccagtctgggcaacaagagtgaaactccgtctcaaaaaataaataaataaataaataaatataaattaattaattaataaaaaataaaaagtgacaagaatagacatttctaccttgttcttgattttaggggggaaagcattaatttttccactagccagtataacgttagctatgggtttttcatagatgctctctatccagttgtggaatttgccttctgttcctaatttattgagagtgtttttcataagagggtgtgagttttgtgtgtgtgtgtgtgtcaagtgtttttctgcatttattgagataatcatgtgaattttgttatttattctattaatatgctgtatcatataattgattttcaaatgttaaacctaccttgcattcctgggataaatctcactttgtcatatcgtagcatcctttttatattactggattcattttgctattataatatcttattaaagaataatgcatctatgaacattagagaaattggtttatagctttttcttaaaatgcatttatctggctttgatatcagggtaacactggccttcaaataaattgggaagtgtagctattctttgaaagagtttgtgaagggttgatattacatcttctttaattattacatagaattcaccagtgaagccatcaagttctgaagtttctctgtggaaagttttaagctaattcaatttctctacttcttagagctctattcagattttctatttcttcttaagttttgatattttttgtctttctaaatatttgtccattttttggtctaattagttggcataaagttgttcgtaataacccttataatctttttcatttctgtaggatcagtaatgatgtcctctttctcattcttgattttggaaatttgtgtcttctttcttttttcttcaccggtctagttaagcatttcttaagttcattgttctattcaaagactaattttcgtttcattgatttttctctggtttttctgttttctgtttcattgatttctcttgtaatctttattccttcctttcttctatttgctttggacttagattagtcttctttttctatcttcttaatgtataaagtgggttattgatttggggtcttttctgttacaggcatttaagcactcctttagctgaatcctatacatttttatatgttgcgttttcatttacatttagcttaatgtattttctaatttccctagtgatatcttctttgacccatgagttatatgaaaatgtgttgtttaattttcaagtatcatgggatttcccagatttacttctttcactggtttctaaattaattccataatagccacagagcctactttatataattaatctatttaaatatactgagacttgttttgtggcctaacatatggtctaagggaatgtttcatatacacttgaaaaaaaatgtatattctgtagtcagagtgatgagtatatgtcagttagattgaattggttagcagtgttgtttaattctatatcctttttgattgtatatctagtttttctatcaattattgagaggtagtaatgaaatattcaagtattttatggatttatttagtttaacttcaattctgtcagtttttactttatatattttgaagctttgtttttaggtatgtataaattcgaaattgttatacttcctgttgcattgaccctattatcattaggaaatattcttatatgtctccggtaatatgtcttgtagtcaagtctattttgtctgatgttaatatagccacttgagctctcttatggatgctgtttcatatgtcctttcccattattttacttctagtctctttgcatattcaagtctgtgtcttctatctcttgtagacaagatgtagttggatcttggtctttgcttttttggtttttgttgttgttgttgtttgtttgtttttttgagatagggtctcactctatcacccaggctggagtgcaatggcctgaacatggctcactgcagccttgccctcctgggctcaagtgatccttctgcctcagcctcctgagtagctggtaccataggcacccgccaccatgccctgctaattcttaaaaaattttttgtggagatgaggtcttgccatgttgccgaggctgatctcaaatcctggacagaagcgatcctcctgtttcagcctcccaaagtcctgggattacaggtatgaaccaccacacctggctggatcttagttttgtgaaaaggaaataaaatcttgggaccccaaactcattacgccaaagggaaagttaagcttgggaactaagtcacataaaaactgccttccttttcttttcagatagctgaaatttcacatgcttgctttatcttatgtaaaatgtacatgaacgcataaactactttccccgcactcctctcttttcacatgtcaaatgtggattcagtgaatgctaatcaaagcctcacaagcatctccctttctttgttttttttttttttcttccttcctcctttccctccttcccactctttcccctttaaatgtcaaagtcctcaaagccctgtttggaagaagcacaggccataggtcctactttaacttgtgtttttttttccgaggcacatcctcaaccttggcaagactgacttctaaatcaattaagatctgtctcagacactttttgatttacagttttcactccaatatgataatgtctgccttttgattacagggtttagacttgacacaggctttgcttaagaacctcaaattaataaaatttctgctggtgtatctgtgagtgggcaggggacacattaaaaattcaggtcatttttaagcagttttcaagcttttactttttacctgcattccctctgtgtcttgtgtacagcctcatggttgaccatgagtgtgtggctaccttgtgatgtcttcagtctcttctgcacaaacacacagataaccagaaatatgcttgccccaatcagaaaggcaatctcaggctactaaagccaccccttgcccactgccaagatggtcatttccagaccatcttggatgtgggtgtcctccactgctccaaatgaggcaagcccctttcatggtggcagtgaagctgctggaccacatggtccacctgccctggcagaacattcccttcacctctctggggaggggaaatggaagcagccccaggcaagaatgccacagaatcccactgttagtagtttttttgtgcacaaatgcttcttagattgttagattcctttgatcaatttgcagggtactgaaattgttgtttctgccaattttgttcagttttatagttgctttttgagaagaggattttttgacctcttcacttggctgtagccagaaatctcactaacagaggctgggggcactgaaacccatctccttcaggacaattggaagcttcagtattgaatgaggccttttagatcccaaaggctgctctcacctcacttattatagagcagagttgcacaataccagtttgtttgtgatgccattctaaggaagcttagttaatgaaatggtaaaagaccttcaccaaggggcatttttctcaacacagcaatcctcagtggagacttgtaggtggtgttccaatgtattagtagatatatttttgtgttttaacattcatgacttgaa

SEQ ID NO: 497 - DNA, 13879 bp, Homo sapiens
ctcagcctcgcaaagtgctggaattacaggcatgagccaccactctctgccttatctgtattttatgtatttatttttttgacatggagtcttgctccggcccagactggagtgcagtggtgtgatctcaccttaatgcaacctctgcctcccgggtccaagcgattctcccacctcagcctcccaagtacctgggactacaggtgagtgccaccacacccagctaatttttgtatttttagtagagatggggttttgccattttggccaggctggtctcaaactcctgacctcaagggattacccacctcagcctcccaaagtgctgggattacaagtgtgagccaccgtgcctggccccttgtctgtattttttaatataacatcctagtggatgtgaggttggatctcattatggttgatttgcattttcctaataaataattatgtttttatatgctttagataaatgttttgataggcagaacaataagctcccaaagatgttcacctcctaatccctagaacctgtgaatatgttaccttatatggcaaaagatacattgcagatgtgattaaggatcttgaaatggggagattatcctggattattgaggggggcaatatagtcaaaggagttcttaaaaataaaagaggatgcaggagaatcagtgaagaaaatatgacaagggatgaaaaggaaatgtgaagcaggggtgatagagaaagatttgaagatggaggaagtgctagccgggcacagtggctagcgggcggaccacctgaggtcaagagtttgagaccagcctggccaacatggtgaaaccccgtctctactaaaaatacaaaaattagccgggcggtggcacacgcctgtaatcccaactactcgggaaggtgaggcaggagaattgcttgaacccaggaggcagaggttgcagtgagcagagatctcgccattgcactccagcatgggcaacaaaagcgaaactccatctcaagaaaaaaaaaagaagaaaaagtggccgggcgcggtggctcacgcctgtaagcacagcactttgggaggccgaggcgggcagatcacgaggtcaggagatcgagaccacagtgaaaccccgtctctattaaaaatacaaaaaattagccgggcgtggtggcaggcgcctgtagtcccagctatttgggaggctgaggcaggagaatggcgtgaacctgggaggcggagcttgcagtgagccgagatcacgccattgcactccagcctgggtgacagagcgagactccgcctcaaaaaaaaaaaaaaagaaaagaaaaagaaaaagatggaggaaatggccacataccaaggaatgcaggccacctgtagaagcttaaaaaggcaaggaaaacagattctccacaaggaaggcagccctgctgacaccttgatattagcctgatgagaattctgccctacagaactgtaagacattttgtggtgttgtttcaagccagtaaatgtatggtaatttgttagagcagcaatcagaaattaatacagattttaagcatcttttcattgtgcttattggccatttgtgcatgtgtatatacatatatatatataaatacattgtgtgtgtgtatatatgtatatatatatatatatgagacagagtcttgctctgtcacccaggctggagtacagtggcacgatctcagctcactgcaacctcccctccctgggttcaaggaattccccctgcgtcagcctcctgagtagctgggatcacaggcatgcgccaccacaccagctaatttttgtatttgtagcagagatggggcttcaccatgttggccaggctggtcttgaactcctgacctcagatgatctgcccacctcagcctcccaaagtgctggggttacaggcgtgagccaccgcacccagccaattttgagctaacttttaaaaaattatttatttgtcgccaggttggagtgcagtggtgcaatctcggctcactgcaagctctgcctcccgggttcatgccattctcctgcctcagcctcccgagtagctgggtctacagccacccgccaccacacctggctaattttttgtatttttagtagagatggggtttcactgtgttagccaggatagtctcaatctcctgaccttgtgatctgcctgcctcggcctcctgaagtgctgggattacaggcatgagccaccgcgcccagcctttttttttggagatggagtcttgctctattgcccaggctggagtgcaatggcgcgatctcagctcactgcaacctccgcctcctaggttcaagcaattctcctgtgtcagcctcctgagtagttgggattacaggcgcgcaccaccatgcctggctaatttttgtatttttggtagagacagggtttcaccatgttggtcaggctggtctcaaactccggacctcgtgatccacctgcttcggcctcccaaagtgctgggattacaggcgtaagctactgcacccggccctgaatgcctattttttcttgcctaattgccgtggctagaacttctaatatgatattgaatagaaggagcaagagcagacgctcttgttttgttcctgatcttaggtggaaggtattcagtctttcaccattaaatatgattttagctgtcttctgggctctcttgtttctgatgagaagtcaactcttaatcttattggagtttccttataggtgacaggtcatttttctatttgtgcttgcaagatattctctttggatttcaagatttttgaccatgatgtgcctgagtgttttgtcctgtctaaccatggctggaatctctcaaaaatgagcagtaagggagttcccacaagggagtggctgaaattgaggagagaggccatttctcctactgtcccctgtctccaaagaaaaggaggaagtaaaaactgaaaaataacagactgatcggcaccactggccaggcctgtaggttaaagattaacccacaacctaaccgcttgtgatatctatatatcacagacaatggtatggagaaacacttgccttgctcaccacccccacctagtcatgtaccccatgcttgttcaatctatcacgaccctttcacgtggaccccttagagttgtaagcccttaaaagggccaggaactctttcttaggggggcttcgttcttgagacgcatgtctgccaacgctcctgaccaaataaagcctcttccttacatttcttggttccctgaccgggaagcgaggtgattaacgatggtcgaggcagccccttaggcggcttaggcctgccctgcggagcatccctgcaggggactccggccagtttgagcaacgcggatcctgagagcactcccgggtaggcatttgccctcgtggaacacctcgtcagagcggtgcatggcaggcccccacagaggatcaatgcagcggctgaacaccaggaaggaactggcacttggagtctggacatctggaatatggtaggaccagtcctgggaacttacccactccatttgagtggaagcgtggcctgatcacccacagtgtgcccttatcggcactttggtctcagttttgattatgatttggcttggcttgtttgaaaaaaaggaaagtgaaagtgagtgaatgcttgttttagacgggcacaggatggacagtggtcgccatccaaagtgagcgttgagccccaagctgcagttccgtaggatacctcacatggctaagtggcagttcgtgctggcgcctggtaccagcctgcttaagctaagagtatctgagattcccgcgagggaagcggccagtgactgccgaggagagtgggtgacccctttaccctttcccttcttgtgtcgtgagtgccatttttgtcttgggtgggggtggagatgggtgagacgcaaagtaagaccactccattaggaactatgttaaagaatttcaaaaaaggttttaatggagattatggggttactatgaccccaggaaaacttaggacctaagtgagatagattagccagcattagaagtgggttggccatcagaaggaggcctagacaggtcctttgtttcaaaggtatggcacaaggtaactggtaagccagaaaacccagaccactttccatacatagacacttggttacagctggttttagaccccctacagtggttaagaggacaggcagcagcagtactagtggcaaagggacagacagccaaggaagaatcccgcttcacccactgagggaagtcggcgcctaaagtcctgtccgacccaacatcaaaggattcatggcaagaaacagtgccagtggcccctcctttcaccaagaaagaaggcctcccactcctgaggccactgtgcccaagcttccacaaggcctacatacccctaggccacctagagtagaaaagaaaggatgcaagacctcaggagaaactcctcacttggtagcccatttgaggcctaaaactgggatacaaatgcccctgagagagcaacggtatactggggtaaacgaggacgggcatatggtggaaaggcgtgcctttgtgtaccaaccctccacctctgccaatctcctcaattggaaaaacaataccccatcctatactgaaaagcctcaggctataattgatttgctccaaactattatccagacccacaaccctacttgggctgattgccaccagttgctcatgtgcctgtttaacacggatgaacggcgaagggtgctccaagcagcgactaagtggctagaggaacatgttccggctgattacaaaaacccccaagagtatgtgatggcccagttaccaggaacagacccccagtgggacccaaatgaaagacagggtatgcaaaggctaaactggtagagggaagccctcctggaagggttaaagaaaggagctcagaaggccaccaatataaataaaatatctgaggttattcaaggaaaggaagagagtccagcacaattttacgagagactatgtgaggcctattgtatgtatactccctttgatcccaacaaccctgaaaaccagcgcatgattaacatggctttagttagtcaaagtgcagaagacattagaagaaaactacataagcaggctgggtttgcaggcatgaacacttcacagttattggagatagccaaccaggtgtttgtgaatagagatgctgtaagccgcagagagaactgcagagagagcgaacgccaagcccagcgaaacgccgacctgctagccacagcaatagaggggtcccccccgaaggggcgagaaaggggggccccaggaaaaatacccagtccggccatccacgcttgcagcgtaaccagtgtgcttactgtaaggaaatgggatgttggaaggacaagtgcccccagttgaaagggaaacaaggtgactgagcaggaggcctcagacaaggacgaaagggccttgtttaatctggcagaagggttactggactgagggggactaggctcatgtgcacccaaagagcccatggtcagaatgacagtcgggggcaaggacattgagtttcttgtcgatactggtgctgaacatccagtagtaaccaccctggtcgcccccttatccaaaaagactattgatataatcagaaccacgggggtttcggcaaagcaagctttctgtttgccctggacctgcactgtcgggggacatgaggtaattcaccagttcctgtacatgcctgactgccccttgcctttactgggaagggacctacttagcaagctgagagccactatctcttttacaaagcatggctctttacagctaaagttacctggaaagggagtcatcatggcccttatggttcctcgggaggaggaatggagactcttcttagctgagccaggccaagagataggaccagctctggctaagcggtggccaagggtgtgggaggaagacaacccgccagggttggcaatcaaccaggcccccatactaatagaagttaagcctggggcccagctggtcaggcaaaagcagtacctggtccccagagaagcccttgagggcatccgggtccatctcaagcatctgagggcctttggaattatagtcctttgtcagtctccatggaacactcccctcctacctgttcccaagctgaggaccaaggactacaggccagtacaggatttgcatatggtcaaccaagcaaagtgactttgcatccaacccatacacattgttggggttgctgccagctgaggacagctggttcacctgcttggacctaaaaaatgctttctttagcatcagactatctcctgagagccaaaaactgtttgcctttcagtgggaggatctggagtcagctgtcaccactcagtacacttggacccggctcccccaagggttcaagaactcccccaccatcttcagggaggcactggctcgagacctccagaaaattcccaccagagacctaggcttcgtgctgctccagtacgttgacaacttcctgctgggacaccccatggcagtcatgtgtgccaagggaatggataccctgctctggcacctggaggactataggtataaggtgtccaagaaggaagctcagatctgcagatagcaggtatgttacctgggatttactatccgacagggagagcacagcctgggatcagaaagaaagcaagtcatctgcaacctgctggagcctaagaccagaaggcaggtgagagaattcttaggagctgtagggttctgcagattgtggatcccaaactttgcagtattggctaagcccctgtacggagtcacaaagtgaggagacacagaacttttcaaatgggggtcccaacagcaatgagcttttcatgagttaaaagagaaactcatgtcggccccagccctggggctacctgacctaacaaaacctttcacactgtatgtgtcagagagagaaaaaatggccattggagttttaatccagatggtggggccctggccaagaccggtagcctacctctccaaagagctagatggagtttctaaggcaaggtctgaaagatgcgagatgtagaagtaccagcctaacaacttttcaagtgactcttggcctaggtgggtggtctcatgcacagccagtatgactgcggctcctagcagttgtggcatggctattcttccatccgacaactggatccatccctcttctatcacctgccctccctctgcctggagaaagtccaggcaggatgaattgctggtgaattatctcatgccccctgacagtgcaggtctggggcaaacagaaagcttgctttgccgaaacccccgtggctccaattatatcaatagtctttttggataagggggcgactggggtggttactactgaatgttcagcaccagtatcgacaagaattatctgtcgataattgagcctggcccctgtgcttaagagccttggcagcaactgccctgctagcactagaggcagataagctacctcttgccctaactttatgtttagggcaaaacctaaacataaaggccccctagctgggcacggtggttcacgcttgtaataccagcactttgggaggctgaggcgggcgggtcatgaggtcaggagatcgagatcatcctggctaacacggtgaaaccccatctctactaaaaatacagaaaaattagccgggcatggtggcgggcgcctgtagtcccagctactcgggaggctgaggcaggagaatggcgtgatcccgggaggcagagcttgcagtgagccaagatcgcaccactgcactccagcctgggcaacagagtgagactccatctcaaaaaaaagaaaaaacataaaggcctccccatgctgtggtaacactaatgaacaccaaaggacgtaactggctaacgaatgctagactaactaggtaccaaagcttgctctgtgagaatccccgcataaccattgaagtttgcaacaccctgaaccccgccaccttgctcctggtatcagagagccaagttgaacataactgtgtagaggtgttgcagtcagtttattctagcaggcccgacctccgagaccatccttggacaacagtagactgggagctgtacgtggacgggagcagctttgtcgacccacaagaagagaggtgtgtaggatatggtaatcctggatgctgtcattgaagccaaatcgttgccccagggcacttcagcccgcaagaccaaactcattgctttaattctggcctttgagctaagtgaaggtaagactgtaaacatttacactgactcttggtatgcctttttaactctccaactgcgtggggcattctacaaggaaaaagccctgttgaacgctgggagaaaagacataaagtatcagcaagagatcctgcaattattagaggcagtgtggaagccccaaaaggtggctcatgcactgcagaggacaccagcgagcttctacctcgattgccttggggaacccccaagctgactcagaggctcgaaaagcagcatccaccccctaccaggcatcagtcacagccccctgctccctcaggcacctgaccttgtacctacttattctaaagagaaggactttctccaggcagagggagggcaggtgatagaagagggatggatccagttatcggatggaagaatagctgtgccacaactgctaggagccgcagtcatactggctgtgcatgagaccacccacctaggccaagagtcacttgaaaagttgttaggctggtacttctacatcttgcatctttcagcccttgccaaaacagtggcgcagcagtgtgtcaccttctggcagcacaatgctaggcaaggtctaaccatccccgccagcatacaagcttatggagcagccccttttgaagatctccaagtagacttcaccaagatgcccaaatgtggaggtaacaagtatttgctagttctagtgtgtacatactctgggtgggtggaggcctatccaacacggaccgagaaagctcgtgaagtaacccatgtgcttctccgagatctcatccctaggtttggactgcccttacaaatcagctcagacaacgggccggcatttgtggctgacttgttacagaagacagcaaaggtattggggatcacatggaaactacataccacctactgaccacaaagttccggaaaggtgaagcagatgaatcgcactatcggaaatagtttagggaaagtgtgtcaagaaacaggattaaagtgggtacaagctctccctatggtattatttaagattagatgtaccccttctagaagaacaggatattccccttatgaaatattatatcataggccccctcccatactacggggactcccaggcactcctcgagagctaggtgaaattgcgttacagcgacagctacaggctttagggaaaattacacaatttcagcctgggtaaatgagaggtgccccggcagcttattctccccagttcaccctttctccccaggtgatcaggtgtggatcaaggattggaacataggctccttgcggccacggtggaaaggaccccagaccatcatcttgaccactcccacagccgtaaagatagagggaatcccagcctggatccaacacagccaggtaaaacctgcagcacctgagacctgggaggtgagaccaagcctagataacccctgcaaagtgactctgaagaagatgacaagccctgctccagtcacactcagaagctgactggtccacgcatggccaaagcatgagaaaactcatcgtgggactcattttccttaaattttggacttgtacagtaaggacttcagctgaccttcctcagactgagaactgttcccagtcactaaggtaggacaaaatcaagtcactaaggtaggacaaaaggttgctgcagtcctattattttatagttagtatgagtgtactgggactctaaaaggaacttgtttgtataatgctactctatacaaggtatgtagcccaggaagtgaccagtctgatgtgtactataacccatctgagcccccctatgactactgtttttgaaataagatcgaggactggcagctggggaaaagctgatactagtaaagtaataactagaacagaagagaaaggagtccccaaacaaattatcttaaaatttgatgcctgtgcagcaatcaacagtgacccatatggaaatagaataagatgtggctctctagattgggaaaggggctatatagtagaaaataagtatgtttgtcatgaattaggactgtgaagtgatgaatgtagttactggtcctgtgtcatttaggccacctggaaaaaaagatgagaaggaccctgtccgccttcaaaaaggaaagagtaactcttcctgcactagtggtcactgtaacccattgaactactaattaccaatccccttgatccctgctggaaaacaggagagtatgtaactctaggaatcgatggaactggactggatccctgagtaaatattttagtccaaggggaggtccacaagcgatcttccaaaccagtgtttcagaccttttatgatgagctgaatctgccagcaccagagcttccacaaaaaaggacaaagaacttgtttctccagttagcagaatatgtagctcattccctcaatgttacttcctgttatgtatgtgagggaaccactatgggagactgatggccttgggaaacccaagaattagtgcctactgatccagttcctgacataattccagtccagaaggcccaaactagcaacttttgggtcttgaaaacctctattaatggacaatactgcatacctagaaaaggaaaagacttcaccatccctgtaggaaggctcaattgtctaggacagaagctgtataaaagcataacagggacacagggacagtcacctggtggggtctaaaccatactgaaaataatcccttcagtaaatttcctaaattacagactgcttaggcccatccacaatctcatcaagactggatggctcccgctggactatactggatatgtaggcacagagcctacactcagttacctgatcaatgggcaggtagttgtgtcattggcaccattaagccatcctttttcctactgcccataaaaacaggtgacctcctaggtttccctgtctatgcctcccaagaaaagaggagcatagctatagcaaattggaaagatgatgagtggtgccccgaaaggatcatacagtactataggcctgccacatgggcacaagacgactcatagggataccatacccccatctacatgctcaactggatcatacggttacaggccatcttagaaataatcactagtgaaactggcagagctttaactcttttagcccagcaggaaacccaaatgagaaatgccatctatcagaatagattggccttagactatttgctggcagctgaaggaggagtctgtgaaaaattcaacttgaccaagtgctgtctgcaaagagatgatcaaggacaagtagtcaaaaatatagttagagacatgacaaagctggcacatgtacccatgcaggtttggcataggtttgatcctggatccctgtttggaaaatggcttccagctctaggaggatttaaaactcttataataggaatgataatggtgttaggaacctgcatgttactcccctgtatgttacccatatttctccagttactaagaagcttcgttatcaccttagttcatcaaaagacctcagcacaagtatactacatgaatcactattgatctgtctcacaggaagatctagatagtgaggatgataatgagaactcccactagtgagtgaggttctcaaaggggggaatgaggagagaggccatttctcctactgtcccctatctccaaagaaaaggaggaagtaaaaactgaaaaaataacagactgatcagcaccactggccaggcccgtaggttaaagattaacccacaccctaaccgcttgtgctgtctatagatcacagacaatggtatggagaaacacttgccttgctcaccacccccacctagccatgtaccccatgcttgttcaatctatcacgaccctttcatgtggaccccttagagctgtaagcccttaaaagggccaagaactctttctctgggactcagttcttgagacgcaagcctgccgatgctcctggccgaataaagcctcttccttctttaacccagtgtctgaggggttctgtctgcggctcgtcctgctacaaaatgatcctgagatgggatgagttgggattccaaaaacagaagcactaaatgccagggcgataagcccaaaatgcatattgggggaatttacatacagagtgctgcagagacagatcgcttgtggacctccccttggactaaaatatttactcagggatccagtccagttccatcgattcctagagacagcactctgtccttatgagggacaatgagagaaaaggggtgttctacttaggtatgtccacagccaaagggtcacggtatggagtttatatgaggctttaaggaatttgttcagggctagggtcagtttctttcagtgcttgggcaacaacccagatacctttatcagtgcctgggaatgttcaaggccttggtttgggttcaagcctgctgagaaaaacctgcagctcgctgggtggaagaatggccaaagcactctgtgattttaggtcagaacacaaaaagaaaggaggaggaactcagggatcctacactaggtgtggacctctttgcatttatcttacttgttcattgaacttcttggatgtgtagattaaaatttctccatcagggacccacgtggtgactcatgcctatagtcctagtactttgggaggcttaggtgggcagatcacttcaggtcaggagttcaagagcagcctgaccaacatggtgaaaccctgtctttactaaaaatacaaaattagccaggcatggtggtacatgcctgtaatcccagctactcaggaggctgaggcaggagaatcgcttgaacccaggaggcagaggttacagtgagccgagattgcgccattgccctccagcctgggcaacaagagtgaaactccgtctcaaaaaaaaaaaaaaaaaaaaaaaggccaggcacagtggttcacgcctgtaatcccagcattttgggaggccaaggcgggtagatcacctgaggccaggagtttgagaccagcctggctaatatggtgaaaccccatctgtagtaaaaactacaaaaactagctgggagtggtggtgggcacctgtaatcccagctactcgggaggctgaggcagagaattgcttgaacccgggaagtgaaggttgcagtgagctgagatcacgccactgcactccagcttgggcaacagagcgagacttcgtctcaaaaaaaaaaaaaaaaaaagggaagaaagaaagaaagaaagaaagacaaaaattagcttagcatggttgtgggcacctgtaatcccagctgctcaggaggctggggcaggagaatcacttgaaccagggaggtggaggttgcagtgagctgagatcgagccactgcactccagtctggttgacagagggagactccatctgaaaaaaaaagaataaagaaagtttctccatcaggctgggcatggtggctcatgcctgtaatcccaacaggttgagaggcctaggatggaagatcccttgagcccaggagtttaagaccaccctgggcatagcaagaccacatctctacaaataataatttttttaaaaacctgggca

SEQ ID NO: 498 - DNA, 109880 bp, Homo sapiens
tcagtcatattcttggtgcctgtacagcttttagttcttgaactcctggcctcaagcaatcctcctgcctcagcctcccaaatgctgggattataggcgtgagccaccacatctggccctatattattatttacatctttttgtacgttagaggtatttcctaataaattaaaataaattcgtatacagaaatattaataaatatgtcacctgtccttagttcattagattatatgatgattcttcaagttatatgatctcatgccctgtctgattccatttggggaatacgcattcctccccgaccttaaatccagctctcttctccactgagaattctctccctcccatctgtggctgagattaaagatctgcacctgaagcactgaagaatgtgtgggtaattaaattaccctgccgattcctggagatgctgattacctggagatgacctcagagattatcctaaattaactcctacaagatacatattgcagcgggaggtgaggtaggggaaggattgtgcacctgaggctagcaaaggtttccactctgtttagagatgatgtcaccagtgcgtttacatttgcgttgtgttcacacattgagtgctactatgtacaagaccatgtgtcagacactgaggtaacaggtatagctactagatagagttcatagctatggaggcaagcagattcactgactgctaattctaacatgatgtgacagtgcaactagaaaaacataaacaagcactatgtgagcacaaagaaggtgcacatcaactccttacaggtacctgtaaaagccaaagggtaacagttggattgcaccttgaagaggatgcacttttttttttttttaagacagaatctcactctgttgcccaggctggagtgcagtggggcaatctgggctcacttcaacctctacctcccgagttcaagcaattctcctgcctcagcctcctgagtagctggtactagaggcatgcgccatgatgctgggctaatttttgtattttcggtagacgtgaagtttcaccaagttggccaggctggtcttgaactcctgacctcaaatcatccacccacctcagcctcccaaaatgctgagactacaggcgtgagccaccgcgcctgacctggatgtaagattttgataggtacagaacaaggaaaagactttccaggccgggcacagtggcttatgcctgtaatcccagcactttgggaggccgaggtgggcagatcacgaggtcagcagttcaagaccagcgtggccaacatggtgaaatcccatctctactaaaaatacaaaaattagccaggcatggtggtgggtccctgtaatcccagctactccggaggctgaggcaggagaattgcttgaacctgggaggtggaggttgcagtgagcaaagaccgcgccactgcactccagcctgggtgacagagggagactccgtctcaaaaaaaaaaaaaaaaagactttccagaaggagcagcataaacacaggcatgacatgtttccataatggcaagtggccctaaatgactagaatataaggtagatccagtaggaaaggacttagaaggggctttggaaggtgagtctggaaattaaaactggggtaaacgtgatggaccctgaacatcattatactgcttaagatgctaatcttaatcctgaaggtaatgggaaaacctcctaaggtttatgttattttctttctacttaggctatttaaaaagtggagtgacggccaggcgcagtgactcatgcctgtaatcccagcactttgggaggccgaggtgggcggatcaccaggagttcgagaccagcctgaccaacatggtgaaaccccgcctctactgaaaatacaaaaattagccaggtgtggtggtgggcgcctgtaatcccagctacttgggaggctgaggcagaagaattgcttgaacccgggaagtggaggttgcagtgagcagagatcgtgccattgtactccagcctgggcaacaagagcgaaactcagtcacaaaaaaaaaaaaaaaaaaaaaggagtgacatgcttagatctctgttttggaatgacaggttttttgtttctagcatcaatccaaggttcatggcttgagaaggtgtactgccagcaatgccattaaccagcaaagggaatgcaggaagaggaacagatctggtgggcatcagtttggatgctctgagtttgagctgcctgtgaaaactgcaggtggtgatatgcaattaacattcacatacggagttcaaaactagagacacaaatttgagagtcatcacagaaatgtgaagtgtgttttctataactaaagataaccatgctaacatagccatgtgttacattagcatttttttttttttttgagacggagtctcactctgttgcccaggctgaagtgcagtgcacaatcttggctcactgcaacctccacctcctgggttcaagcgattctcctgccttagtctcctgagtagctggaattacaggcacctaccaacacgcttggctaatttttgcattttagtagagatggggctttaccatgttggccagctggtctcaaactcctgacctcaagtgattcacccaccttggccccccaaagtgctgggattacaggtgtgagccactgtgcccggccttacattttgtgttttttcctgctgcttgtatgtgtgcaagtctgtgtatcatcaatgggtatatgtgtacctgcgctgacaacaaaaaatgagatgcatatcagctactacacaaagctgttataaggatgaaatgcagttagccagtgctcagtaaagggcagttgctttactactactaggtggggtggtgtatgtgagaatctgtatactgccattagtaggctttagtatgtagtgtgcatatggaattcatgcattagtgtgtagtatgtgtgggacccactcacctgagcagcttctctccccacttacagtggcatctgttgaggattcctgtgagggataaggcagggagtgaacttgttacaaggcagggacagggaatggaatgtgtttatgtgtctaagctgaggcatccaggtcagaggtgctggttgttgaggaagctggcctgggagggcacaaaggcagccaaagctggtgcctggccacaaatatgagctgggattaccgtacatggagatgggggaagggatggacactcacagggacacttagccagaaaaatacacaaagcagacctagttaaaactcaagaactggccaggcacggtggctcacgcctgtaatcccagcactctgggaggccgaggcagacggatcacgtggtcaggagatcgagaccatcctggctaacatggtgaaacgcagtctctactaaaaatacaaaaaattagccgggcatggtggcaggcacctgtagtcccagctactcgggaggctgaagcagaatggcatgaacccgggaggcagagcttgcagtgagcggagatcgcgccactgcactccagcctgggtgacagagcaagactccgtctcaaaacaaaacgaaacaaataaacaaacaaacaaaacacaaaaaactcaagagccctcccgcccctccaaaaatacaaaaactcaatagctggccgggcagggtggctcatgcctataatcccagcactttgggaggccaaggcaggaggatcacttgagctcaggagtttgagaccagcctgggcaacatggcgaaacaccatctctactaaaaatacaaaaaaattagctgggcatggtggtgcaggcctgtagttccagctattcaggaggctgaggtaggatgaggcagaagaatcacttgaacccaagaggcggaggttgcagtgagcctaaattgtaccactgcactccagcctgggtgacacagcaagattccatctaaaaaacaaacaaacaaacaaaaaactcaagagcccaacacacatatgtaaaaaactggacggccgggcgcggtcgctcatgcctgtaatcccagcaccttgggaggctgaggcgagtggatcccctgaggtcaggagttcaagaccagcctgggcaacatggtgaaaccccgtctctactaaaaatacaaaaattagctgggcgtggtggcaggtgcctgtaatcccagttactcaggaggctgaggcaggagaatcgcttgaacccaggaggcagaggttgcattgagccgagatcgcaccattgcactccagcctgggggacaagagcgagacttcgtctcacacacacacacacacacacacacacacacacaaaactggacacaactggccaggcgcggtggctcacgcctgtaatcccagcactttgggaggccgaggtggacggatcacgaggtcaggagatcgagatcatcctggctaacacagtgaaacccgttctctactaaaaatacaaaaattagccaggcatcgtggtgggcacctgtagtcctagctactcaggaggctgaggcagcagaatggtgtgaacccaggaggcagagcttgcagtgagctgatattgcaccactgcactccagcctgggcgacagagcgagactctgtatcaaaaaaaaaaaaaaaaaaaacctggacacaacttactgagatatgaaactatatggatatttgcggagatgtccctaatataccctaaagccagagacaactgataaagactctatacaaatcaaataggcagttatgcagttacaaaactcttctctatacacaaggtctcccaaagtccctaacaggtacccaactagtagaaacattcatacaaacccagggaaggaacacagaattggtaaagtaatggctgatatgcaacaacactgtacagccacaaagtatgggaagatgctcaagcttggggggcggggggtacaaataggtaagaaatttggattggcatgaaagagatatctgacaatgggagtgaagtgggaagggaggctgggacacatctttggagccaattgcttttctggtaggtctttgtaatgtgagatgagggatggggcacacctaccaaagaggctgagcccctccttcagtccactggccactttgtacactgaggggtgagactcactcttaaaaatctgtagaacactgtcgaggagaaatggaggagtttggggtaacttggacttttgaagggaataagaattgaggactgataaatggaatggggacaggggatatcctcctgagatcacgtctttttttttttttttttttttttgagatggagtctcgctctgtcgcccaggctggagtgcagtggtgcaatttcagctcactgcaacctctgcctcctggattcaagcaatcctgcctcagcctcctgagtggctgggattacaggcgcacaacacacccagctaatttttatatttttagtagagacggggttttaccatattggtcaggtctcaaactcctgacctcaggcgatccacccgccttggcctcccaaagcgcggggattacaggcatgagccaccgcgcccagccgagatcatatcttgatgtaaggtttgtcccttacttttctttgcctcagtttctccctatagaaaagaaagctagtatctttatgcttttcttcctctctttccctcaaaaccccccttccctttccttcaaggagagagatcttaatagccccaggattagggaaactagagcctcattaggattattggggcattaaacttaatccttctccctccccagagacagcagcatgcctccacctctttacctgtaagtgtcttgatctatgttcaccagatgagtcctgaggacagaaaacaaaaaagcaggaagcagtctgagttcgttccacaactccacttcctttgtccccctctctgaatattgtcccagtcttcttcccaaagtctcattagcccttagattctcccgggtgtcctagagcacttgacccactgggtcacagccacatccacaccccacccccactttacttttcaggcctcccaatcccacattactttggttggggttggggtgaatcacctacaacataaatttcttaaagcccaggatggggacgctgacattatagtcttccagttcaaccccgattcttcttcgacccaggaacttcagcagccctccaagtgctcgaacctgggaggggatcagcagtggaatcggggtaaatcttaaatctcctgggggctgcagagcaccagggaaagttactattttccagggctaggccagtacctcccagaattcagccctagcacttgtgccgcctcccagcccttatcccccaggaccaatctcactgtgaggaggcagtcaaagggaataatggaagagaggaagaggattttctcagtggcagtcatggcgtctgggatgaaggagtagtttccagaaaggaggcgttgtttgcttatctccagacctatttgagggaggcaagcaaagggaacggtcttgtagctcaattttttcaccccattttaagaatgagacaatagaagcaagagagattatttgacttgcccaagctcacacaggcagttaatggaaagctagagcaagaaccaaattttcagactcttagtctaattctctttttattctacatataatataaagatacttgtctgaaagcacagcctgagaaagataaatggctgaggaaagtagacatctgtctggaattgaggattttggtcaaaataatggtattaatagaactagtaacactaatgccttaatatctaattaggatagtacactcctgttcttattgtaaacctaggaaagttatagaagtgccttatggatcataataagggtcactgaggcagtgccttttggtttggtgataaaaggctttaacttaatggggagaattccaacaataaaaccctgtccaaaaagtgtcaccactcctcaggggaggccctcatccctagacatgacttaagcagaggcttcccaataagctgcaggttattaaagggtagggagcaggagagatcttggggggacaggtcatagggcatgaggagcacaaaggtttaggatgacataaggcagaggggagatctgtgatgatgaaggtagagttgggggaaagaatgggacaccggaacagggagttaggcaaagcaaaaggaaggagataccaaaatccacacttggcaaaaatatgatttcaggtcttttaggctctctgtgctcctgggaggctgtgggggaggaaagaaaaggctatcattctttacatctcagtccttctacctctgtctgacactccctctcacccaattctagccccctggaatattccatatattagtccttccccattttccctctatcctttaccaagtccttaccaagctttcccagaaatcgagtcatattctcatcctgtttggcactcgtaacaacagactggggattgatctcatccagaacttggaaggagaacagagatcaaatgagttaaaggatctttgtctttgactaagagaaaacccatagccctcctcttcctacccctctccttctcaaaaacatttcctccctaggagtagggagtgctctgcacagtgggaacacaggtagaagttgagatttagaaaagtagttaagagtggtgggatggtgagagggaagtgggatgttctggatgttgtcactaggctgtaaacccctggagaacagacatgactgatttgcccagggctgaatctgaagcacctgaaacattgtaaatacgtcatatatatttgtggccaggcacagtggctcatgcctataatccctgccctttgggaggccaaggcaggcagatcactggaggccaggagctcaagacaagcctagccaacgtggtgaaaccctgcctctactaaaaatataaaaattagccaggcgtgatggcagattcttgtaatcccagctactcgggagactgaggcaggagaattgcttgaatccgggagacggaggttgcagtgagccaagatggcaccactacacttccagcctgagtgacggagcaagacactgtctcaaaaaagaacaaccaaacaaaccaaaaaacagcctcacaaatatttgttaaataatgaaatgaattcataaaaacaaaagagggagcctctgtgaagcaactgtaaaatatattgagtcagtgctatagtttggatgtgatttgtccctgccaaatatcgtgttgaaatttaatccccagtgtgatagtgttgtgaggtagggcctagcaggaggtgtgtgggtgatgggagtggatcgctcatgaacagattaatgcccttcctggagtgtgttggtgggtatgagtgagaggttctcactctattagttcctgagagagctggttgtcaaaaagagcctggcatctccctcccccttgcttcttctctgccatgtgacctctacacaccctgccttcccttcttccatgagttgaagcagtctgaggctctcaccagtgaagatgcccaattttgagctttccaaccatccagaaccataagccaaataaaactttttttttttttttaacaaattactcagagtcaggtatttccttacagcaacacaaaatatgctagacagtgaggtgagttaatgtaagtaaaacatggctgggcgtggtgactcacacctgtagtcccagcactttaggaggccaaggtgggcggatcacaaggtcaggagtttgagaccaccctggccaacatggtgaaacaccgtctgtgctaaaaacacacacaaaaaactagctgggtgtggtggcacacgcctgtagtcccagctactcgggaggttgagtcaggagaattgcttgaacccaggaggtggaggctgcagtgagccaagattgcgccactgcacttgagcctgggtaacagagcaagactctgtctagaaaaaaaaaatatgtgtgtgtgtgtgtgtgtgtgtgtgtgtgtgtgtgtgtgtgtgtgtaacacatctgcaatcccagagagcagaggaattcatggttccatccccacctctctggagaagcttgaggctctcgtggtctggggcatctggcatgaagtggatagtggagtcactagtatcatagtaggcaatgcccaagtatcctgaattccacagcacacacagatggatctgtccagcaaggaagaaaggaaatcactattagaatcactcataagtgtagggtttaccatgtcttatataatttaatcattttctcaaatctctgagataggcatcatcacccccatttagtgaatgtgaaacagccactcaggaggtaagagacttgcccagctcttcccaaccctgttttttttttctttctttctttgagacggagtcttgctctgtcgcccaggctgaagtgcagtggagcaatctcagctcattgcaacctccgcctcccgagttacagtgattctcctgcctcagccttcccagtagctgggataacaggcacgtgccaccacgctcggctaatttttatatttttagtagagacggggtttcgccatgttgcccaggctggtctccaactcctgagctcaggtgatccgcccgcctcagtctcccaaagtgctaagattacaggtgtgagccaccgcgcccggctcccaaccctcttttattctaacttcccatcaactctccattcaagtttctactcccctcagagacctcggccagctcctcctcctcctcgacttcctcctcctcggcctccctggggcccggcactggggccgggctggggaagccggaggaggccgccccaggtctcggtccctgcggtgtcctccttgggttcgctcctaaggaggccatgagcttggaggctctgcggatgcaaaaagtgagggcggttcggaagcaacgattcacagaggaggccggggtagggtggcgcgcagaatgcaaagcactaagtacttctgctacagggctgcggggcagggctgaggggcgtggagagctgtggacacaggaggtgaattctcgggtatttaactaaagtacagattgtgggaaactccacgcgccccaccctcattcctgtcacgcggaggttaccctttggaaggaaggggtctgagggccctgtggggcgagtcgtgcacgtcttatgtctctgcctctgccaaccacgcgccaggaccccagcctcacgcgcttatcttcctcctcccccagctgccgccatcgcagcgttttcccgccttttcagtaacctgagtcgctacaggtgggagaacgccccgctgaccgaccgccacgagcctgcaaaaggagcgcgccggcgcgtgagcgaggtgcgcgcgcacgcgccccgccctcctaaccgctgttgattggagaggcccggatccagcctagagatccgacagggcgaggaggagaagcggactgccgtagctgaagagtctggacgctgattggcctatttgccttcggggcgggtccagaacgttcaaacttcccgccctctgccgttgcttagcagccgggcctctagcactcactgtttctgggatttgattggcgcagtgggaagcccgcgagaaggtcggaccagggtccgtagtcccagtccctggaaggggtttgggaccgttgcgggggttttgagggggaggccaaacttaaagagccagaggcgcttattttttttcctgcaacaactcttaagttaatatttgtaccctctgagttaatatttatacagagcttagaacagtgcctggcaaacaaagtaagacctaaatgagcggtgtttcaaataaataagcggaaacaagcaggacttctgtctcagccctaccgtgcctgtttcctgggtacagggtatgaccacccccataatggcacgacagggcctaatttattatttaaacccttcaagcagaggtggaagcattcgaattacatcaaattctggcagagagaagtagttctgatcagaacactcacacccctactgggacatgcccataccccttcgcacttctacacacccctgaagacagagaggtatctatcattcatgcattcggcaactatttagtgcctattttgggccaggggttggactcaaagcggtgaacataatgaagtcactgctccataaagcttatttgtgcgtctgtgtgtgtgtgtgtgtgtgtgtgtgtgtgtgtgtgtgttgcgggggtggggttatgagggagaaagaaaaaaaatatatatatatatatatataatccctttaaatgcaccatcctccccagctttgttcctagtaccctgagatggggagattcctccccagccccccaacccaagaagttaggaaagatggtgggggtgagatgacctagctgtgctaaccagtaattggaaaatcccctccagcaagaaaggtgggggaacagagttaagggctgggttaatggttacccctggcaaatctgttgagcaatggagctatagaaacttggaggaggttggtgacagctctggggagtgtcagggagggacccaccttccaatctggggtgtgaagagattagggactagtttaccaagcccaggaaggggagggagtggaaagagaagcccagagagggaaagaggagctactgagataggagaaatgcagggacagggaggtgagatggagggaaacctctgttgcaggatttgggggtacagccctggctctgctggatggttccaggagagggcagcgttgcctgtcacctggtaaattaaggcacgataccctgtgggtagtcatgccagccagccaaagtcaatattgatatcaaggcagctgtagctataaagctgtaggagagaaaagagaggccgggagaggctgccaaacctgtttgatcttcaagctggccccatttacctaaggcttctcttggacacagaccagttggaacaggagaggaccctgagaagtagagttgttttgatcccctcccctcaatgggaaggggtcctgtgtgcagattttgagggtcaccatgagggaattcacacccacacagaggcatggaatcatacccttacaggatgttacagttcaagggaacgaacaccaaagatagcctttctgtcgggaggagagaaaaaggccctcccacaagcaggagaaaacccacagaagaggaagcacaagaggaaaccaccaactgctggtttccagcagcacatcacgtcactccaccccactcctcccccaagtctctccctttctttaagtttcaagctctgttttagttctgtgttcttgcactccaccatggttttctggaactgtaggtcttttgttggacagagggtgatgaggaggatagagaagggatggttggacaggagagaaattcaggatatggaggctggaattctgggtttattttttcagcaggtcataaaggtttaatagaaatcaaggttactggagagagagctgctcctcctatgtcctccctgcttatttatttaggtgtccccaaggactctactcccactattctgtctgatctttctttatccccatgacaggaccagctaacaacacccctaccccaccccctatacacatacttcaggatcgggccatgataatcccacccctctgccccatctccaaggcaacctgtcagtgagacgaggacaaagggcacaggaaggggccccaataggaaacataagtggaagcacaaagctgaccaagctacaggaacagacccctccctgcaacaaagccccttgcctcggctttatgtttccttcgcaaaagacttcgtcatctcccttcccatccctaactctactttctttttcttttcttcttcttctttttttttttttttttttgagatggagtttcgctcttattgcccaggctggagtgcaatggcaccatctcagctcactgcaaccttcacctcccgggttcaattgattctcctgcctcagcctcccaagtagctgggattacaggtgcccaccaccccgcctggcaaatttttgtatttttagtagagacagggtttcaccatgttggccagtctggtcttgactccctgacctcaggtgatccaccccccttggcctcctaaagtgttgggattacaggcgtgagccacctcacccggcccctaactctatttcctatgcccaatcccaagtgtaggccacaaggactgcaagtcctagtgctgagctgggcccggagacagtagactgcggggggcacaggacctactgagacaccagtctgggcagctcagggagtgctggcgtcaccccttccctaatcccaggctgcatggctaacggttcctatctgcagtcccagccttccacttccgagttcttctctcagaccacagtcccagcaacccagaatttggattggagtctggaagaaatgcagaatgattaaacgaccacctttccatttgaagtccccatccctgaatcttcacgggtgtgcccaagctgttagtgtcaagttttttatatgagggtcagtcgggttgtactcagattaatgaagcagggaaactgaggcagaaaagagtcctgtgttcaggagaggtcggagaaacaaggaggttttcaggactcctccttaacacccccatccccatcctgtgggagatccgaggattccccttccggactcactccctacatcgtcgagtcccgcccccctccagtcccctccccaggttcagggcggggccggtcggtgagtcagcggctctctgatccagcccgggagaggaccgagctggaggagctgggtgtggggtgcgttgggctggtggggaggcctagtttgggtgcaagtaggtctgattgagcttgtgttgtgctgaagggacagccctgggtctaggggagagagtccctgagtgtgagacccgccttccccggtcccagcccctcccagttcccccagggacggccacttcctggtccccgacgcaaccatggctgaagaacaaccgcaggtcgaattgttcgtgaaggtaagaacacttctctcctcagccacccaaattcctggaagccaactctcacctttcccccggtccagccttaactccccaatcccttccctccttgactcccacccccaatcccacgtgcactctttggttgaggggtggttttgagaggggaagacattaacttgttagcaagtaatgagaattctaggatcaaccctgaaaagtttgtaaaagtgcaagtttctagcagactaaaggaagggaagtggagaaaaaggagaattcccaaaagtgagactggggtggggttagagggcgagctggtgaagggacagtgggggcccagcagggtttagaagggacagaggggaacctcagttaggacatgtgtccctacaagatctgagggtgagtagtgcagtaggagaggtgtgtgtgtgtgtgtgtgtgtgtgtgtgtgtgtgtgtgtgtggatggagacgcttcagggaagacggtgtgttgagggaggcctgagagtgagagcaagtaaattgggaagctttggaggggcggaacaaaacaggagactgggatcggagtttgaaaagcagagctggagaggtgatcgggtggcattgaatatccccaggactggggaaagggacagaaggggaggtggcaagaagacgtgagtttaacgtagctaccacaaggatgggtgggagagagatcagacggaggagaagagctcggttagggcattttgggatttgggggttggagaagtagaagacttgccccaactctctcctctctctgcgggtgtgggtaaggagagatggtcctatggcatttgggtagcaaaactgcaggcagcaggcttctcggtgtcacccagcccccctctgattgcagcggccgctcccctccctaccgctgctgcattcatttcccagtcttgggacctcctggctgtgcccctccctcccttccttaacagtgtcctcttctccccgctccgtttgtgtctctccgttggcacgcacgtctccccactctccactttcctgccgcctttctttccccttccccccttttgtttctctcatctttgtgtgtctctgcctgtgtctccctctcccttctgcttgggtttctcgggcagccattccctctccctgggcccagggaagtcggagcctgcttgggtccgcccccttaggtgtggtccccacctcactctcacattcgcctccggggctatttttactcgtgggtgaggctgtgccgcagagattccggccctgtgtcctgtgagaggatggttattgcagtcagaggacttgtgctgggagaccctggcagcaggttaggggtagccttagctgcccaggcctcatcctcactgtcccttcccccacatccttgacaggaaggaagccggagacagagagatgaatcaccctcagcttagggggaggtgtcccttgggccaatgaggtcaccacttgctaattagagggcagcccctctctgtagggccctccacatctctagcgcgaggcccagggccccttgactagactccccacccaaagacaccttggattggaggtgtagagaaccaaaactctggctcccaaaccccacccacctctcctgtcttcagactctactcccttcaggaacccagaaatccaggcttctagcctacaactctggcctcactgaagttccacacccttccctctctaggattcagatcctcccaagttctccaggacctcctccctctacctacctcccacctgtcctcagtgtctggggaaccagaagcctgcctttgcaaaacagtttcccattgatctgccttaggtttgacccaggcccaagggcaaagagcccatagtgaggggacagtgtatgtgtcatgactaggcagaaaacagctggtctgggagtgggaatgcagggactggcctagggatgggtggggtgcatcaggcataaccttgggttggggttacttttcaggctggcagtgatggggccaagattgggaactgcccattctcccagagactgttcatggtactgtggctcaagggagtcaccttcaatgttaccaccgttgacaccaaaaggtaggcctgcttatgttccttgaaacacccctggtgtacacatgtgtgcaaacacacacccacccgagtccttctgtcatgaacatttttgccctccccctggagtccctttcttatcccacgtcctccattccccctttctggttcttcctgacccccatttccagtcctgattcctgatcctttctccaggcggaccgagacagtgcagaagctgtgcccaggggggcagctcccattcctgctgtatggcactgaagtgcacacagacaccaacaagattgaggaatttctggaggcagtgctgtgccctcccaggtataggggcactcagaaagtggagaggtggagcagggagattctgggaaacagacagtttgcagaaatggaaaacagagatggtggtggggctggggcaggagagctagctgaggttcctcccaggaagacatcttacctcatttttcccattggctttcaggtaccccaagctggcagctctgaaccctgagtccaacacagctgggctggacatatttgccaaattttctgcctacatcaagaattcaaacccagcactcaatgacagtgagtcttgtgggtcagaggcctgggtcctgggaggaatagagaggacccagcgggtaggagacattaggggcacctggacgttcagatatcagggagatgaagcagatgttcgtaaatttcccccagcttcccatttttgctttacctctatatttccctgcattttcattggccaagacttttaagcttttctcatttgttccctagcctcttctgccccactgaggacgttagttggctgctggcctgttttctggcagaatagggtcatgcttaagaacagtcatcactctagatccagactacctgagtacaaatccaactagccgtataattttgagcaatcatttcacctctctgtaagtccatttccagatccacaaaattaggatgacaatacctatttcatgggttgatataaatttttttttttctttttttttgagatggagtctcgttctgtcgcccaggctggagtgcagtggtgcaatcagctcactgcaacctctgcctgccgggttcaagcaattctcctgcctcagcctcctgagtagctgggattacagacgtgcatcaccacgcccagctaatttttgtatttttagtagagacagggtttcaccatgttggccaggctggtcttgaactcccgacctcaggtgatccacctgcctcggcctcccaaagtgctgggattacaggagtgagccactgcacccggcgatataaatgagtttgtaaaatgtaaagtgttcactttgggaggccgaggctagcgcaccacctgaggttaggagttggagaccagcctggccaacatgactggtctctactgaaaaaaatacaaaaattagccagttgtggtggcaggcacctgtaatcccagctactcaggaggctgaggcaggagaatcatttgaatctaggaggcagaggttgcagtgagccgggatcatgccactgcactccagcctgggcaacggagcaagactccgtctaacataaaataaaatgtaaagtgcttagaataacacatagaaaagtaactacatgagtgttagctattattattttggactcaccattagtatccacccccaacgggccttttcggactatgtcaatcttttcctgaagttctaatcagttccctctcttgcacagatctggagaagggactcctgaaagccctgaaggttttagacaattacttaacatcccccctcccagaagaagtggatgaaaccagtgctgaagatgaaggtgtctctcagaggaagtttttggatggcaacgagctcaccctggctgactgcaacctgttgccaaagttacacatagtacaggtgtgtggttattgcgggaggagaggatgaccactggagtggccctttaaggagctcccacatgggcttcccctgacaaccactctaaagacgatttctttcttagggtggttttcataaattgctaccaatggcagaccccaccccagtcctttgcagcagtcattgctaacaagaccactgcttgagataattatattccatgatgtaagtcatgggtgcaaacagactagcaaagaggaatacatcccagtattacttttgaagaatgctcttcctgtctcggtatcactgccaaattcccagattagacagagcaggcttttcctaaagtcaaagctttaactttctttataacttcagtcttcacttcctcttgtggaagatcaaaactgctggttcccatgtttttgtcatagtctcaaagctatggtttagtttgtgcaacatgggcctgacatcagtctgccacacaactatgtagtgaacatctgtgtactaagcattgaaagatacacaagtgtatggtgactgggccttgctctcaaagggttgaaatctgagacaataaaatattcacatgaaagttaagaatatatgatgaaaagtcagatgggccgggcgtggtggctcacgcctataatcccaacactttgggcggccaaggctggtggaccacctgaggttaggagttcgagaccagcctggccaacatggtgaaaccccatctctactaaaattacaaaaattagccgcacatggtggtgggcacctgtaatcacagctatttgggaggctgaggcaggagaatcacttgaacccgggaggcggaggttgcagtgagccaagatcgcgccattgcactccagcctgggtgacagcaagactccatctcaaaaaaaaaaaagtctgatgaaaaatatagagacaaaagtcacctgtgtcagtgcctgaagtggtatagggggaaaaagtcactgtggaaattcaagaggagaattttataagtaaattatatctcaagttttaaaaactcaggaaaaatggctggttattaaaagccaggatttcagtaagtgagaaggaaggctaacgacagtacaagacagtgaggagttgagctggttttatcatgtcggcctggggagaagggaaagccaaggtggcttccctgggtctaacatgttggtccctctcctctccccatcctcaggtggtgtgtaagaagtaccggggattcaccatccccgaggccttccggggagtgcatcggtacttgagcaatgcctacgcccgggaagaattcgcttccacctgtccagatgatgaggagatcgagctcgcctatgagcaagtggcaaaggccctcaaataagcccctcctgggactccctcaaccccctccattttctccacaaaggccctggtggtttccacattgctacccaatggacacactccaaaatggccagtgggcagggaatcctggagcacttgttccgggatggtgtggtggaagaggggatgagggaaagaaatggggggcctgggtcagatttttattgtggggtgggatgagtaggacaacatatttcagtaataaaatacagaataaaaatcaagtgtttttacgcaatggggatttaaagtgtgggcgacatggaatgaggggtgggtcagtgatcttgagctcagggcagaagccaggaattaagaagggaaatgtttgtggtggggctgctatgtttcgtgccggtccgccggtccgccgttgcgctgttctgaggtctacgaagcgtttgcagccccgtcgccagggccggccagatctgggtgggcctgggcagcgctcgctgggcggtgccgatttctggcaaggggggcgcagtctggatgtaatgggcgaggcttagcagggcggaatgggcgtggcccgaagaagccccgccccgtcccgcttagacaatgccccggagccgccagaccgtcgcgcccctgccccatcgtagtatatgagctcgcctacacaaggacccgcgctaaaagccagagctcccagtccccgaggcttgaagacggggactcccttctccaccaactctgtcctcggggggtggggccccagccgagatcacagcgcgacaggagtgggggtggccgctggaggtgagtcttgcgtggggggccctgaaccgtgtgggggccggagtttgggggtgccgggcccatgcctgcaccagacagagagtatggggagccggtatttgggcgcggagctaggcggggtggactttgggacatagacggggaaccgggtcctggagccgggagtagtgccagcgccccggaaccacgccccctgttaccccgcccctcgcatttcgttttagacctctcccagtccttcgggactcggtctggtttatactaggtcgcgctaggggcagcgtgaccagccagggcggagagaggatgcttaactccttaggctcgaactcctcccttcctacccacctctctcccttctcgttcgggtattcaggacttccattccccagcccctgcctctccagctttctccttctgtcccataacccctgcgggtcgcgggctggacttccagtccctgcggtagcgagcagctgagggttaagggggcggggctgctgcatttttggggagtgagcgcatcctagtggctgccaagaggggcgcccgacagggacctcacaagcccccaagcaggggcaacaggtgttttggagattagagaccctagccttgttcctcaggctcctcttaaagaatctgacccctgagggtgctgggtagagtgaggtcgacaggagcggaaggtctggagtgggtggggcggagtgggagggacgcctagagatggcaggaggaagacctgggcgctcttaaccacccccaacgcccttgtctgcatgtctttttctctgtctcctccttttctgtttcttctcccagacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtgagcgccgtggcgcgggtgtggtatggggaaaggcagaaggaactggatgtcggggctttggggaagaattgaggatgggggtgtcacagctccgtgccctcttctcctatcctaaggtcgatggagtccgcaaagccctgcaagacctggggctccgaattgtggaaataggagacgagaacgcgacgctggatggcactgacgttctcttcaccggtgaggctggggggaggcataggtcttggcacagggaagtagagtttgggagactcggccgtctggagccttgtttctaactcactcccgccctcaaacctccgcggcctcccggactcaggccgggagtttttcgtaggcctctccaaatggaccaatcaccgaggagctgagatcgtggcggacacgttccgggtgcggagcgggaccagcctagggagggagggggtgcaggtgggggtcggaagggcctgggcgcccgctgaggaaatgagaggcagagagcagcctatgtttgaagataccccatcacccctcccgcgcccctgaatacctcccttcgctctccctaggacttcgccgtctccactgtgccagtctcgggtccctcccacctgcgcggtctctgcggcatggggggacctcgcactgttgtggcaggcagcagcgacgctgcccaaaaggctgtccgggtgaggagggggcggggccaacgaaagtgggcgcagttctgggcccgggaggccgggagctgggaggcttaggaaattagccctaacccctgccctcaatgggctgtccatcttacatgaaagaacacaggagaaaataagaagttacaacagcaggactgggaacaggggtgattaatttgctcttccggagtttcaggaaaccccaaaggtggcacctaaactgtgactctaaggatgggtaggacagataggaggggctggggaaggtagggggttgaaaataactgcatgtgattccaaggtggaaattagcaaaggtaactaaagtacttagtgtctgacatatcgtaagctctatgtgcttgctgtcattattttccacaaatgtcagtccgtccccagcccttagtggtggttgagcaggcagacacagctgtggagaggttctgagactcgaacacttcctctttcctctaggcaatggcagtgctgacagatcacccatatgcctccctgaccctcccagatgacgcagctgctgactgtctctttcttcgtcctgggttgcctggtgtgccccctttcctcctgcaccgtggaggtggggatctgcccaacagccaggaggtgagagagggcaggaactccaacaccaagcaccatcagagaaaagagtttcaggctttcctagtgggaggaaggaagggtaccttctctagaagcctgggtggggccactctgagctggctggaagagtggcctggctcagcctgaggtctcactcccctctccccactccatgtcttccctgtgcaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgaccttttagactgggctgtgactggtgtcttactggggcaaagggatagggcagggctgaaacctgagtttggggtcagtgcagggaagaaggcctcttattcaaaaatcttgttaggtacttatcaactcattgcccaaccatgtcataggtacttgagcacaagatgaacaagacagaatttctatcatgggaagtgtgtccagggcagagaaaagagtgtatgggtggattgctcactgaatttatctaaatgttagatgattcagagactggtagattaccagtccacccctatttgataaagaaaaagaaatgacacttccagggacattcattttcattcattcatttaatgaggcttagcaatgatatcaaaagggtcagtctcctgacgttggggagctcacagtacatgcaaatttcttacaaattgaaatacaggttgtcatggaacaatttacagaaggctgtttctatgagggaaataaagggggtgcgccctagggcatcaaagtatatgcaaggggtggccaaggagggtcaccttcccagaaaaggccatacttgaactaaggataaataagaattagccaggcagatagtgtgaaggagggaaaggggtaatacaggaagaaggaattgcactgggcaaagacattttggggctagggagaattctctaaggctggcattttctaagatgtgcatgtggaatgacacaggtaagcctggagagtggacaaagtgctgtagtaccttgtatccaaagccaaggcacgtgggcacagagctgaagctaaggagagtacttcagttctgtaataagggctgtcaggagcagttatctcttgagtaggatctctctgacttcagggaggaaagcaagggtaggaggatgaggtggggctatgggtaatccaggaaggaagtgagcagagtacattcacgtggcagcgctgggcatggaatacagtgtgggtttgacagtgatgttaagatagaaagactggacttcatggctcattgtgtgggagtaagagagaaaggaggtctgcgtgactcccagtttctgggttgggcaactgggttgttaaagagaatacagaggagaattaagtgagcagcttcagagatgacaatgagttgggtttgacattcagagtgcgaaatgcctgaggtcagtcaggcagaatgtctaagtggaagtttgttaatcccaaatctgagatctgagccagagagagttctgagtgtcatttgcagaggagggggctgaggactgactgttgatgagagtgtcccagaagaagagaaagggacaaacctagaatggtgggaaatactgtagggatatggagcaaggaagaggagtccaaaaagaaaacaccagcaacaaagaaaaacagcttaaagaatcaggccgggcgcggtggctcacacctgtaatcctagcactttgggaggccggggcgggtggatcacgaggttagcagatcaagaccatcctggctaacacagtgaaaccccgtctctactaaaaatacaaaaaattagctgggcgtggtggcgggcgcctgtagtcccagctactcaggagcctgaggcaggagaatggtgtgaacccggcaggcggagcttgcagtgagggagatggtgtcactgcactccagcctgggcaacagagcgagactccgtctcaaaaaaaaaaaaaaaaggagctagggcttgattgggtatagagaggacactggtggtgagggagacatggaggttataggagagatgggagtaagtttagaagtaagaccagtggcagagacagcctggaacccaggtctcccaactcccagtctagcacttatttctataccatggtgccttcctcttccaggtgaggaaccaaggaggggagagggattatggggagctgggatcccctagcttgggaggtttggagtaagggcttcccttcaaactacaactgcatagatggtggaggcatcagcagggtccgctgtggacagccggcggggcctgctgagggctagatggtccagatccgcatagagcaggctctggaggaggaaggggaggaagacaagatggtctccacagtcttccttggggttcaggcctttttttttttggtccattttcctcagagattctggctatccccttcccatccccatgcccttaccggttcctggtccaggtcccctggaatcttgggctcttcctcctttactggcctctggggctcggttttcacaagtggagctatgtgggggggacagagctgaaggatggagagaaggtgaccaacgtgtctgctcccagcaagggctcagactcaggaattgaggggtggggagtgggcatgtaggagaaagaaaatggggtggaattagtctcaccaaatctagggagtggtcgaatcggttgcgggggcaggcgcctgtaagggacatatgagtctttgagaaccaccagtcttgtctcactggttctcctgggactcgccacgccaaggacagcccagcaacttgaaggctcagaccggaaacaacttagactctaccccaccgacagtccagcccaggctctaactctgctgcacttccagctcatctgctctggtggggctctactcaccagtcagcggcctcgctcccacctttgacctctcccattcttcgccaagccaggaccagagctctaggtctagctctttcttttgcgaaggttctggtcctgccccttccacctctggtcactccccatttaacgaggccgggtccctcctgctcacctgtgcagccaccagaccaggcccaaagctcccagtccgagcaccaacccagcgcccagcagcgggatcaggagctggggatacacggaccctgggggaaaggcgtggcggggagggatgctgaggtcaggggtttgacgagggacagccagcagtcccgctcaagaacccccagccaaggccctcttccctcctccgggtatgtgtcggagttaagtacccttgtgcgcacaggcctgcacctaccatgggtaggcccgggggccttgcaataggtcctgtcccccagcacgtgaagcactgtacggctctcgtcctcgtggcggcccttgcagaaaaaagtgcccgagtcccccgcgctcaagaggagctccagccgccggataccagagtccagggagcgtaggcggccgacgaaaggctggaggggaggcacggtgggggtcccgctcgaagaggcccacaggatcggtcggcgtcctttggacaggcccttgcaggccgggaagctgggtgcccagacccagcggatgggatgagagactcctccgcaggagagattcacccggtccccagggcggccgtccagagaagctaggagaggccggaggctgtggttagggcacgtccacagggcaagacgaccctccatcccgtctcctctttctcttctctgttctgcactccagccatcctggatcttcccacacacaacccaccctactaggcggcccttatcttgcttcagcccctctgcgtctatcacaactctcccagggatcgcttacccccagggttcccttgggccctcgagagcagcagcggtagcagctgcagaaacacagccatggttaggatgtggtgaggagaagctgcgagcgaatcagcggcgtggggccggttggggggggaccggagggaagttaggcgtggggagaacggaggggctggggggctccgataagagagggggcggggccaccagctgcccagatccctttgggaatcctcgcaggcaaactcggagtcttcaaatggttctcacttaaaatgtgtgctcgggccatttacacaaatgctttggcctgcttaacttttcaggtgcgcctgtaatcccagctacttaggaggctgaggagggaggatcgcttgagctcaggaggtcgaggttgcagtgaactgtgatcaggccattgcactccagcctgggcgacagagccagccagaccctgtctcaaaaacaacaacaaaaaaaactcctgttttgtaggggattgtgataacgaaataaagtaatacatgtaaactgcttagaatacataggatcactatgtaagtgcttgccattattattactatttctattcttttttttttttttttttttgagtcagagtcttgctctgtggccaggctggagtgcaatctcgactcactgcagcctccggctcctggattcaagtgagtctcctgtctcagcctcctgagtagctggaactacaggtgcatgccaccacacctgactaatttttgtattttcagtagagatggggtttcaccatgttggccaggatggtctcgatctcttgaccttgtgatccacccacctcggcctcccaaagtgctgagattacaggtgtgagccaccacacccggcctactatttctattcttattttagcttctacctcacctctctgtgcccatgctgttcctcctggcttggtaccctgcccaagttggcaggttttgactggggaggtgctttggagcaggtgcacacagccacacctaggacaattgctgctgctggactggagcaacaaggccacaccaagcgcaagtggagcacgggtgacatcctgagaaccttcatgggagcctgaggcagccctacttagcagacctgtggtggctctcctggatgagtagccccagcccctgcctctgctgctgtggcatcacagaagccatcagtgagtcacttattgctgagcaggcattggaaagaccgagtgggggctgaatggagattaatttgacccattcctcccccaatttccaccagcatgcccctatcaatgcccagcagggacccagggacccaaattcagcaattaatttgggccacatccttttgtccattttccaggaaccagcagaagctgccaccatggacactgtaaatcacagaggcctttgatgatgctcattcagaggactgagcagcaggactcttagctggggaccaggaagggcatcttggcctgaaaccaagaaccacaatggcattggccactagtggcacctgccttcccccatccctctctcccatccctactccccactcagtcctgctcagtgccttcccaccccttgtcttttctctggtcagctgcgtagtaagtgagaagggaggggctaccagaggcagggaagggaggagcctttgggtttataaattccaaaaaggccactcaactcctagagctggatccttgaaaatctactctatcagctgctgtggttgccaccattctcaggaccctcgccatgaaagcccttatgctgctcaccctgtctgttctgctctgctgggtctcaggtgagcacctgggggccccaaagacctggtttgcctggtcaggacctttacaccctgctctacccacttcccggccctacccaccactcgggatcccaacacccccagccccaactggctcagctctcctgtgccaccaagaccaggcttccctatgacagcctccttgctctatttctcaaaaagccaggtctccatccatcctccccacctccaagaaagacccatttctctcacctgccagggctctgggtcccctgttccccactccaaggtgtctcctccttggaaactctggtatccagttccccaaccagccccacttcaatatgcaactctccagagtctagcttacctgccttctcctctatctgctgtgctcagtaaggtgtcctctcgaagacctaggcatccagccccaggctccttttgtaacctaccctccccatctactccatcagggactcacatgttcagtctctcagccatggcctttcctagataccccctactcccctcctgggttgcatacctcctcccatacaggggatacaaactttctagatggttgcagtgacatctaagagcctccatggaaacagagcgttttcttgagccttctgaagaggggacaactgggccacttacctccagggtgaagtggatttcactgaggtacacttaccaggctcttccaccctcggaccctgcgtcaccaaatcttgcctgcccaaaccttgaattaactgaagcaggaaacttggggtgccaccttctgtatccaccctctccattttgataaggtgctaagatggaatctggtgatctgtctctcaggtatcattcctttctgctgaagagctactggggtgagaggattctattcaggtctggttcctcttgccacactcttgccagctccaggaggtgaagagtaaattgtaaattgctaaagctggccacagatggctttctcgccagcctcaagttccaaggcatttctgacagtgttgtaaccctcatgattttcatttttattatttctccttctttcaagtttccatctcctccttcaccatccacattctttccccatggtatcttcctcacattccatctatctccagccccatgtttttcttcatagttctgtccctcttgactcacctccaaacggggtggagtgatggaagatatgtagggcgtgggcctttcacaaagcaacagctctacccttacctgccgcccactttccattttccctgcatcactcacctgctctgtgcttgctagaccaaacagccaaacaggttggagcacctacgggatgggctcttctccaccctccacccctgcccccagctcagcttatccccaggtaagtcagagaccccatcacctcagcctgacttgtgtcttcccagctgacattcgctgtcactcctgctacaaggtccctgtgctgggctgtgtggaccggcagtcctgccgcctggagccaggacagcaatgcctgacaacacatgcataccttggtaacatccccttccttagtggggtgaacagggaggtgggagcctctatgaccaggactgaggcccaaatgggtctaagactgagatggagaagcagaggattatagcaatgataatatttggccaaagatggttgtgtgccaggcaacatcctatgtctttgcatgcctttttttcaattaatgttcatgacaaccctgtgatgtgggtgctattattatactgagaaaacggcctcaaaaagagacagtaacacagccgggcatggtggctcatgcctgtaatcccagcactttgggaggccaaggtggttggatcacttgaggtcaggagttcaagaccagcctggccaacatggtgaaaccccatttctactaaatatacaaaaattagccaggcatggtagtgggcgcctgtaatcccagctactcgggaggctgaggcaggagaatcgcttgaacctgggaggcggaggttgcagtgagctgagatggcaccactgcactccagcctgggcgagagtgagactctgtcttggaaaaaacaaaaaaacaaaaaacagagacagtaacaggtccatggccagcaagtgatagaaccaggactgggggagtggtgggtaaggatgtgcagaaggaagatcagactaagaaaagagaaggggagggccagggacagagttgggaaggaaggaagcctaggtgggtggatggggtggggaggtggacacaggcatgccaggtgcccatcctggccgattccctgcccattcccacccctaggtaagatgtgggttttctccaatctgcgctgtggcacaccagaagagccctgtcaggaggccttcaaccaaaccaaccgcaagctgggtctgacatataacaccacctgctgcaacaaggacaactgcaacagcgcaggaccccggcccactccagccctgggccttgtcttccttacctccttggctggccttggcctctggctgctgcactgagactcattccattggctgcccctcctcccacctgccttggcctgagcctctctccctgtgtctctgtatcccctggctttacagaatcgtctctccctagctcccatttctttaattaaacactgttccgagtggtctcctcatccatccttcccacctcacacccttcactctcctttttctgggtcccttcccacttccttccaggacctccattggctcctagaagggctccccactttgcttcctatactctgctgtcccctacttgaggagggattgggatctgggcctgaaatggggcttctgtgttgtccccagtgaaggctcccacaaggacctgatgacctcactgtacagagctgactccccaaacccaggctcccatatgtaccccatcccccatactcacctctttccattttgagtaataaatgtctgagtctgataaaatgtacatttattataagaagacctaagggtcaggtcacctcccaggaaataatactctcaatctccctcccttacacaggaatccttcagggaggttccctgggaggctgggctggggaaaatggagaaacaggtttttcaggtcttcatcctcccttccagtgtctccaggtggcacacaacaactcatatcctaaatttaggccacacccctgatgtattgccaagaagaaggtgcggcctggcttgagggctctccagaaaggataggagaggtacatggagatggggcctgagaccctgtttcttcagtttctctcaggttagagtcaaaggcctcacctagcctagttagtaagtagggcatcaagcagtttttacctatcacagtttttacatttcttttctcaattcaaaatagtcctattgggagccaacttgcaaatgggaaataggggagcaaacccagactcaggctcacaaaaccctggcaaccccactcaatgaatctcattgctaaggaagattcaacccagcaacaggatccaggagccacagaaggcagataagccattgccctttggggtttagttggttaaggagtgcaccactgtaattaagcccgctgttgcttggtaacccccaaactagaacctggatgccccatattacgcttttagccctcccatcaaccaaagatagatgtaattttccagtcagctgtagagtggttcatagattttaatgactcacagaaggatgtttctcttctcacattagatgttcagatgtcccttgttcccttgctcccttgttcccttctctactcctactccccctatccgctccacagtcctggcaagagacaggtcagggcggtagctgctgcagccaaaatgcctgcaggggccacatggcttgccacggcgctgttgcacaggtctcccaggtagcagtccctgtgggctggataagtcacgtctcccaccgactctgtctccacttgattgcaatgatgggctgcgacgcaggctggatgttggtgaatcaaggtcactggggctgagagagagaatgaaactggggtgttggactcctggcttcaggacttgccttctggggcagagcagatgtgatttcaaggagcccaaagggattttcagccccctcaaaaaacacctccctgaaaccaagtgatcaaagttaatgcattgaccttgtaaactcctgatgtgatgcagcaagaaggatgcaacatcacttctgcagtattcttgcttaaaatgcatgacctcaatctcatcatggcaaatatcagataaataaatatcgagggacattctataaaataatttttagtatttcaagtatctgtaattttttttttttttttgagacggagtttcactcttattgcccagctggagtgcaatggtgtgatctcggctcaccgcgacctccacctcttgggttcaagcaattctcctgcctcaggttcccgagtagctggtattacaggcgggcaccactacacccggctaattttgtatttttagtagagacgagatttctccacattgatcaggctggtcttgaactcccgacctcaggttatccacccgccttggcctcccaaagtgctgggattacaggcgtgagccactgcatccggcacgtaatttttgtttaatctaaaaatgattttatttaattttagagaaaagatcttgctctctcactcaggctggagtgtggtggtgcaatcatacctccctatagcctcaaactcctgggctcaagtaatcctcctgcctcagcctctcaggaaactgagattacaggtgtgtgccactatgcctggctaattttttaaaaacattttttgtagagatgggggtctcactttgctgcccaggctggtgtcaaactcctgacctcaggtgactcttcagccttggcctcccaaagtgctgggattacaagtgtgtgccaccaagcctagcctaaaaattattattattattatttttgagacagggtctcattttgttccccaggctggagtgtagtggcgtgatcatggctcattgtagcttcaatctcccaggctcaagcgatcctccctcttcagccccctgagtagctaggactacaagcatgtgccaccacacccaactaattttttaatctgtttgtttgtttgtttgtttgttttttgtagagacagggtctccctatgttgcccaggctggtctcaactcttgggctcaagtggtcctcccaccttggcctcctaaagtgctgggattacaggtgcgagtgactgcactggccctaaaagtaattttttaaactccaggtataaaataatttatcagggctcttcaaatgtgtcagggtcatgaaagacaaagaaaaacagaactggcacagatcagaggagactaagaagacatgagagctaaatgcaatgtaggatcttgctaaatcaaataaagtctgtagattagttagtagtattgtatcagttattttgtgattttgataattgtgctatggttatgtaagatgttagcattaggagaagttgagtatttctgcaacttttctgtcaatccaaaattatgttaaaataaaatattaaaaacatgtacacacacacacacacacacacacacacacacacacacacccctccctggtccttaactaatgccgaaaatttgaagtttggttttaactttggcctttcagggccagagctcttcatttgtgagctaatgggcctatgagattcttttaggagaataaggaggtggggaagtgggggcacaaggactgtgggcctctcaggggctccgtgccaggagccagaaggggtacagactgctctcctctaacagctgcaccatctgcccagagccagactgagcctggagggttctggaagccagaaggattgacatggggctggaggcagggaaaggctgctggaagagggagaaactgaggactcacggtttccaggtagcttgatctgttccaggcctggctggggtctgccctcgccacaggtggtcacggcctctttgcaagaactgctggggcttccaccacagttgtagcaccgcattcggtttcctggcaggagaaaagaggcgctggacctgggccctcggtggagccggctggcagaaggcctgtgtgagaagctagctggccgcctccttacccaaggcagcccctagcagggagctgagcaagatcccaacaaactggggtttcatcgcagtctgcccgtgtcaggaccgcctctacctcctgcccacccccctccccagcccggctctgcctgccttatatcccccgtgccttgagctttatagggctataaaaaaggaagaaagagtctcccccagcaggcaccaagggccccagtggggacagggaggggccccacagcatgctctcagcatcctctggagtcctcaaactcctttatcctcagcagcagtctgtggaccaacaagaacccctgaggatccctgataccctttcacagggtccttgagggtcctccttttgcaactatctgtgtaaggtcagattttcttcatatactggacttcaacgaaaacaacatatcccaacagactgaatgcagaagcagataggaaaacccaggcatctcccacgaagcctgacactagattcacaaaaatgtaaagcaatgctcagcttctcactgtgctgtggagaaataatagttatttttcacaaaactgtattttgttagcatgtaatactttattatttttattgtttaaataaatcaataaatacctactttaaattttctgttttaatttttaatgtagtaaatattgatataacctcataaagaaaagctcttcagagtcttaagtaactttgaaaagtgtaaagaggtcctgagatcaatatttttgaaaagagctgctctcctgggcacctgtgtctcccctatcttcactccctgttcctagtcttactcctcctggtacatgctggctctgattccccagatgggccttcctccttcccagtctcttcaaccccagccttccaggctgtatcaccacccccctaccccaaatcccatccatgccttcctttctagtgatttctccccagtgcaagcacatcagcaggccctccagccccacccgtggttatttctttcctccaaggtagtaaagctggcagggataattacagggtaggaatgttgaagcttggggggatcaaagggatctgaagctgggtggggtccgcccttacacagctgggctttgtgtgtgcatgtgggtgtgtgggtgggggtattgttgattctacactcaaacagatccacgccggggctgtttaggagggtgactttgagagacatgaaagcactgagggggaaagacagagaaaacaaagacagagagaagctgagagagccagggagcagcttgagacatggggagggagggggaggagtaggagggaaggcgacagacacaactcaggagcaggagaggaagctaagttacagagacaacatgctgagagagcagaggagaccctccaggcaagggcagactccttgcaggggcaggctgggggcccccgctgcctgctgggtcaggctggtgaatctggtcatggttccgccccccagattcactccctaggtgtgtttgtttactggttcctcactgtcttgctcaaatgctccaactctacaaatcccgggatctcggggtgcagatcacctctcccagattcctgagcctgtgtctggccatgggcacctccagcatcttcctctgcgtgctgttcctctgtggggcactgggtaagggtgggctggggaaccttcagtggtcagggggctgggggtggggacaagggcatgtggaggaacctgagggctggggaggagaggggtgtgggtgctggaagaggccaagaagagagctgggggagtgggggacttcagggagaccagccactgggaaggccagcctgatgaggtgggaaaggaagagtttcctttcaaggcatttgagaataactgtctcccccttgctgcatctttgatccgcccctgtctcccctatcccttatttcacgtgttgcttctgtgctgggccctttggtcaatgtcaatttctattttcctatctgtctctggtgccatttacttaactttttcactgaccccctcaacttccctgctgctgggtctggctttttgtctcactctttttatgttggtctctgattcttgtggcttctgttcatgtctgcgcatctctcaatccctgtacccctcttgcctccatctctgtttcttttcctgcatcgtctccctctttttttttgagacagagtctcgttctgtcacccaggctggagtgcagtggcatgatctcggctcactgcaacctcagccacccagattcaagagattctcctgcctcagcctcccaagtagctgggactagaggcatgtgccaccatgcccggctaattttttgtatttttagtagagacggggtttcactgtgttagccaggatggtctcaatcttctgacctcatgatcagcccgcctcggcctcccaacgtgctgggattacaggcgtgagccactgcgcccagctattttttctacttctgtcagctttcctcccttattccacagctttcctctctctgcttcatgtgtcacctctctctgtgatccctctccggatctggcctctgcctgccccacagggagggtttgcctctcctgctctcctaatctctgctgcctcaacaggtctcaccatgtcccctgcccggggaaggctccgctgctacatctgtggcttcaccaaaccctgccaccctgttcccaccgagtgtcgggacgatgaagcttgtggcatcagtattggcacttcaggtaggactctggtccaatggcccttctccaggaggctccctacctccatccatccggcctttcctgtggcccccgcctcagcatgcctctttcatcccacagaccagagtgagatcactgagtgaaaaagctgcctctcaagggcccagtgccctctgccaggctatgccacctactggctgcactcctacactctgtggcaccactgctgcgagcaggacctgtgcaacatagccgcttccccacagcagctcaccagcctcctcgcctccctgcccctctttgtggccagcttcgctgggagaggacacctcctccactagcttccgtggatctgcagcccccaacccaggataccccccgccatcactgcggccctggaaacacctgcacagacactttgagacatgcccgagaacctaattttgtacagagaccccagatctctcagcagacccctcacagacccctcacaaggcctggggaggcacctgcccagagtccaacctcataaagaacacctattctgcgtcttttgtcttttctagatgcccattgctgatgccccgtgtcagcccaggtcactggcaaggcaggcattttgatgacactgtggatctcaggcaaggggatcaaaggagcatcaggtatggtaaggaggagagtcttgctaggaaagactaatgtggtaggtcgggaactcaggatggagggcttgggggactatgaagagtacctttaataaaaggtctatctaggagtccagtaatactgcagatactgcagtgtgtgtgtgtgtgtgtgtgtgtgtgtgtgtgtgtgtctgtgtgtgtgtgctctaagagcaaactgtagctgcttggtgggttgggctggagctggaacctggaccacggcactcccctcattctccatctgtgtcattttcgtcctttttcttgccaatggcttagtttaagcccctgcagcctgaagcctttaggtgagacttctgagaaagcttttttccagtaaggcccaagcttgagcagagacacaaaagggcacccagtggagctgcttgtgagggtgtggctggagctcagctcatttctgcctgagactagggaatggccaagttgggagcatcaatatcctccctcgcttcaccagcccagactcgcccatggttcacagacatcccagcatggccccggcccaataaataacatacccccactgggcctgccagcctgagtagacactccctctgcccccgagaaatagggtgtgacctcagggcagcaggaaggaagtgccagagtggcgatagctgctcacatgctctgaatgccccggtaaggcgccacagggaagagtgtgtgcctaggataaggaaggataaggagggggccccgggtgggagctgagcacaggcatctctatcctgactcagttccctccccttgcatgtgaggaagtctggggttgattaaatatgcctgttccctctcttctttgtgaggatgagacatggggtagtgggggtctggcttaatttagagatgggttgaggctttccattttctctgtccctccatcctcccactttgtgcttctatttttctccctctgtccatctctttccactttctctgacttgagtctcttcccttctctctcttcccccgttttccccatttgtccttcagctccactgcaatggattcctcaccattgctcaagtctccagattcctgtctcctccctgtgcacacccatcctccttgcccccaccagcaacctcaggctcccctcaaccccacagtactatgggctcagggccatccctccactgctgctacaagacaggagaccaaacctttttgtaggttacatcacagaataatgctcctcctttccttcagtcccccacccctccccatacacagcttggtggctgctggaggccagctggatggtgaagtcgaactctcagtcccgccccccttgctaaggttgtcgaggaatcttccaggtgccagatggccagcgagacagcaggtcacacttcccagcagatgtcaccaaaatcacctgggcttgtgggcaggtgggctgtggggttttccagagagacagattaaggatacctctacttttcacatcctcaggaacgagggcccatccccaacccaacccgtgtttcctctccatccccagtcccctccaggatttaagcctctgttccctagctgttcctcacccaagacgggccaaatggatgttctcatagacctggatttcgggtttgaactgaggaatcgaggcatctggggagaaggagccatcagggatacagaagagaagtcagcagacaacttagagccgtgttcctcgccccctcccctagaggaggtggggtacagaggcggggtgtgagcctagccctttgcctcccacccatgtgccctcttctttccccggggagggagggactcacctctgcctggagccccacggaccctctgcctccagagcacgatgctgagggccaggatgacaactccctggcccattgtgagcagcagcatcagaatccaaggcatgtcccagcccgtggaaggggcacagagggcaggagaagcatcgatggaggctgtagtaagggccagaccagagggatgggagggaggtagtgaggggccctgtccctgtgccccaaagagaggcttcccctccacagtctggtgggctcttccaacagaagactttgtaagcttccctgcccacaatatcctccaccctactctgcccctttccaggcctctcaccctgacccatagagaatggcggccaggcacagtggctcatgcctgtaattccagcacattaggaggccaaggcgagcagaccacttgaggtcaggagttcaagaccagcctggtcaacatgatgaaacctcatctctactgaaagtataaaaattgaggccaggcgcagtggttcacacctgtaatcccagcactttgggaggccgaggtgggtggatcacctgaggtcaggaggtcgagaccagcctgaccaacatggtgaaaccccatctctactaaaaacacaaaaaagaggccgggcgctgtggctcacacctgtaatcccagcactttgggagaccaaggcgggcagatcacgaggtcaggagattgagactatcctggccaacatggtgaaaccccggctccactaaaaatacaaaaattagctggacgtggtggcatatgcctgtaatcctagctactcgagaggctgaggcaggagaatcacttgaaccagggagtcagaggttgcagtgagccgggattgcgccactgcactccagcctggcgacagagagagactctgtctcaaaaaaaaaacaaaaaaaaacacacacacacacacaaaagttagccaggcgtggtggcaggcacctgtagtccagctactcaggaggctgagatgggagaatagcttgaacccaagaggcagaggttgcagtgagccaagatcgtgccactgcattccagcctggccaacagaacaagtctccatcccaaaaaaaaaaaaaaaaaaaaaaaaaaggccaggcgtggtggctcacacctataatcctaacactttgggagactgaggcaggcagatcatgaggtcaagagatcaaggccatcctggccaacatggtgaaaccccgtctctactaaaaatacaattttttttttgagatagagcttcgctcttgttgcccaggctggagtgcaatggcgtgatcttggctcactgcgccctccacctcccaggttcaagtgattctcctgcctcagcctcccgagtagctggggttagaggcatgtgccaccatacccggctaattttgtatttttagtagagacagaatttctccatgttagtcaggctggtcttgaactcccaacctcaagtgatccgcctgcttcggcctcccaaagtgctgggattacaggattgagctaccatgcctggcctaataataataaaataaaataaaataaaataaaaagtagagaatggcaatgccccctgctcacgcatgggcaaccaactacagagcagaccaccagccataaccacactttcccctcacaccctttatagtaattcaccctttctttcaagaaaaaatagccagatgtgatggctcatgcctgtaaccccagcactttgggagaccaagataggaggatcatttgaggccagtagtttgagaccagactgggcaacatagcaagatcctgtctctacaaaaaatttaaaggtgcggtggctcatgcctataatcccagcactttgggagactgaggcaggcagatcactagaagtcaggaggttgataccagcctggccaaaatggtgaaatctcgtctctactaaaagtacaaaaaattatccaggcatggtggcgggcgcctgtaattccagctacttgggaggctgaagtgaaagaacatccctttccgtctccttcctcagtttacctgccaggctaaagctgacccctttgttgtgagtcatgaggcagcggatgattcttggtcttcggctcctgggctcagaaagcccctccccaggacacaccaagagcagggcagcctcactgccccagaaggactgaacacggcccctcacgggacccttcccttcctgccaggtcacagagtccatgcgtctgctggggaccacagagcacaggaggacattgcagggggatccatctgcagcccttgcagataactgggatcctgtaggggagagagggattcctcagttcttcacctggacttcctgggccacagtagcccctggtctgcatgcccccactcacctttgagcaccaagacgtcgtacaccctccagttctggtagttgtggtgctgacctagcacagcgcaccagtaccgcccggcatcttcctctttggatccctccaaccacaaagaatagttccccagcagtctgagcctggattcccttcctggttttccagggtctggggctggcctgcccacttggacttgggctaccagggtggtgaaggagcctgctgcagggctgcagaaccatgacaggtgttcgtccccatgtagagtaggtggtgagggacatggcagctctactgcctcccccaaggccacatagatggcctgcatgttgtctgtgggaagagggttgtatgaggccagagacctccatcagatcaataaccccccatttgatcttcaaccctggcttccttcccttctggggtcccccagcacaggcctggctggtgaccacatttctcaagtgacagctacaaaaataagacaggtggagagaagagggtaagggctttcctcctctctcccccagccagtgagggggtctgagggcaagagggaaaaggctgaaagttggcaaatgcccacatctcttctactcatttctacttttctggaagcatttactcattcttcttattttataaaggaaactgcataacctggaccctcgttgcctctgggtcttccctagtgtcagaggcaggaggaggttggttggggtaattctatcttcttgagtcagatgccttcgccaggctcctaggagaaagagcagtagtccctccccaaccttgcaaatagctaaggaatcccgtacctcttgccccttacctgcagcctggggagttccacataggaacaggaggaggaataagactgccatggggagagcctgccaagttctcttgctccaagacctggtgtccccagggaggaagcagagtccagataaaggcccacactcgctggtctggagtgacaaggggctctggaggggatgggaatgctggggcgataaagcccagcagcatgtctactagggataaagtgaccaccacttttctatcctggagagaaaaggacccagcccaggccactctgaagatgacctttttgctcttctgattccacatcagctaaggggctcaaataaagactttccatgcaaaaaaccatgcagagaagtggtcctgcctgtctagctcttgtcagtctggaagtacattctgaggtctctttcactcctaagaaaggtcagccatgagttgggtggatcacttgaggtcaggagttcgagaccagcgtggccaacatggcgaaaccctgtctctacaaaaaatacaaaaattagccaggcgtggtgacatgtgcctgtaatcccagctacttaggaagctgagaggcaccagaatcgcttgaacccgggaggtggaggttgcagtgagccgagatcgtgctactgcactccagcctgggagacagagcgagacttcatctcaaaaaaaaaaaaaaaaaaaaaaaaaaagaaaaagaaaagaaaagaaaagaaatgtcagctatgagtgaagaaactgagtttgagtttttatgttggtcctccacagaacccagcacaagactgtgtatcgagtcagtgtcccgtaaatgatttggaatgactttccctgtggttgtctggcataccccggacctctcctgaaaccctaataagtgtattaaattattactcagggacaaggctaacgggctgattcatccttctgaacggcaaaaactcctaaggcagatcttcatgcagttattacagttttaatgtgtaatttatttatttttaaaattattttgatgaaatattccatacataccaaaaactatatgaagtacaactatataatggataaatgcttaacagagtagaagactggacagcaatgagaatgaacaaacctagtgatttgcaacaaagttgaatctcacaatataatgagagtaaaagaagcctggccaggcatggtggctcatgtctacaatcctaacacttttggaggccaaggtgggagggttgattgaagccagaagtttgaggttgggcaacagagcaagaccccaactctgaaaataaaggccagacgccgtggctcacgcctgtaatcccagcactttgggaggctgaggcaggcggatcacgaggtcaagagatcgagactatcctggccaacatggtgaaaccctgtctctactaaaaatacaaaaattagctgagtgtggtggtggatgcctgtagtcccagctactcaggaggctgaggcaggagaatcgcttgaactcaggaggcagaggctgcggtgagcagagatcatgccactatactccagcctggtgacagagcgagactccgtctcaaaaaaataaataaataataaataaataaataaataaataaatagaatattccaggccggactcggttgctcatgcctgtaatcccaccactttgggaggatgagacaggcggatcacctgaggtcaggagttcaagaccagcctgaccaacatggagaaaccccatctctactaaaaataaaaaaattagcagggcatggtggtacatgcctgtaatctcagctacttgggaggctgaggcaggagaatcgcttgaaccccagaggcagaggttgtggtgagccgagatcgggccattgcactccagcctgggcaataagagcgaaactcggtctcgaaaaaaaaaaaagaaaaagaaatagaatattccaggccaggcacagtggctcatgcctgtaatcccagcactctgtgaggccaaagcaggaggttcacttgagcccaggagttcgagaccagcctgggcaacatggtgagaccttgtaaaattagccgagtatggtggtgtgggcctatagtcccagctactcaggaggttgaggcagaaagatggttgagcccagcaggtggaggatcagggcagtgagccgtgattgtgccactgtgctccagcctgggtgaaagagctagaccctgtctcaaaaaaaaaaaaaaaaaaaaacagaaaaaaagaatattccgtttcagtcagagatcctctatgctgtgtaaccacaattctgaattttctctttcttctccacttgctttatcattaaattttatgtgtttttgaatctaatatactagtatcacgtatacattcttctgtggctttctattttcactcagcatcatggttttaagatccagttcatgcataacagtaatgattcatttattttctttttacaaatattccgcatatcttactgtgctgaattttcgtatccaggaccatggtgtagctttccatttattgaaaagcttttcgtttacctctttctttttttattttttcaattattattgttattattttgaggcagggtctggctctgtcacccaggctggagtgcatggagcgatctcaaactcccgggctcaagcgaccctcccaccttggcctcccaagtagctgggactacaggtgggcaccaccacaccctgctaggtcttttttttttcccccttggtattttgtgtagagatggggtctcactatgttgcctgggctggcttggaactccagggcgcaagcaatcctctctcagccaccccaagtgttggaattacaggcatgagccatggcctggaactcctggacgcaagcaatcatccctcggccacccaaagtgttggaattacaggcgtgagccaccgcgctgggccagtttacctttatttatttatttagagacagagtcttgctctgtcaccaaggctgaagtgcagtgggaagatctcggctcactgcaacctctgcctcccgcgttcaagcgattctcgcgtctcggcctcccgagtagctgggattacaggcgcgcaccacccatgccaggctaatttttgtatttttagtagagatggggtttcaccatgttggccaggctggtctcgaactcctggcctcaagtgatccccccgcctcggcctcccaaagtgctaggactacaggcgtgagccactgcgccgggccgggccagtttgccttttcaataactttttatagttttcttcataaaaccttgcatttcttgtactagatacattcctagacaccttatgttttcggttactcttatcaagtactcctaatctcacccctcgtttccgctgtcgctctagagtctgccaataatgagacagaaaaaaattattgaaccatgcccggtaattttctgattctccgcgttctagtggtcttccactagtttcggaccactgctgtacccgtagctccaactgcgcgaaactcttctcaggaagcactgaaaatgtcgcaactcgcccggaggcggagccggtacgggctgacgtcaagggcacacaacacctcagaggcagggagggcggggccggcagggggacctgctgctggaagagcagcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggtgagtcgagttcctccccaccgaagaacgtggtacagtccaaaccctttacggccttttgctccccagaagtgcccataatgggaaataaggggagcctgcttgtcaagccagttatccgcaaaatctgcgctctgtgtgcttcctgagttaaagtcacgcctacggactggccgcctcctttctttttcgctctttaccgctttctcattccgactgccactctttgttctttcctctccgcgtccccccgaccctgtgtgtcgtggttcgtgccggtcccagttgagtcttgagtcccgggaagagaccctgcgcggactggggagccgttgaattttgctgtcagactcccagtttcctcttcttcagtgcctcttcatgcctcccccggctctgtttttatcttccctttaccctcgccttgaatttcagaatgacttttacagatcctgtatccgtcggtcctcccctcaacccccgcccaacctagcctggagacccgagtcattgtattctggagagctggcgggtggtggtaggctgttctaaatattctcttcctttttatcagttgtctcattgtgttactgtctcctacaaactgcccgctcctacccacattctcttcttagtcaactactcttatttctgatgcttttctttccttcttagattgtctaggtgtcttttctttcttctcaaactaacccttctccccacatgcacgcgcctgcaatccatttgaaactaggctgtggaaaaggagcaaaaatcgtccaatgctgctttcacttttgcttccaaatccagctccctgtgtttgttcccatggtcaggggtgggaaattaggttcagagtgagggtgaggaagaggagtttctgtgggggccagggatgtttcaagagagatagtcaacgagactagaaccagaggacacacagcagggcttctgaaagggaagggaaaggacctgccagtgggcagggtccttaaggaggccatctgttttggcaggatacgtactatcagccccgtgccctggagaaacatgctgacagcatcctggcactggtatgtctaccctggcatctgggactctgcatctttcagacccacctgtcctcttgaacttagccctccctaacttgggagcaacagtgccctggggttgggggatgccctgggctctgcagcagacctctccaacacagacacacaggcacactctaaatgtgcatacttggcactcccctttggtatgtagcactgctttctctgggggcaacctgagccgtaaggaaaacatgtttactcttgggaccatctgcaggtgctaagtcctgcagttccccagtgacctgtcctccctggcaactaacctctttggctgcagggacagctgttctttctggcacagttcctgtggtgacgtttgcgcatctcttggggaccaggccaggggctgtcctgagcagggccaattgaaaaggcttgattaacttgagtagacagagagactgcctttaaatgtgatggaattatgtctggagatggaagacataattcttccataattccagaggaagaaaatagagcctgtaccaaattttcccagcctccattacattgacacactacttttcaacaaatactgagcacctactgtattcatggtgtcatacaccaaatatgatatgatatccctcaggttgtccatcttgctcagagtgtatagtatatgcctggaatggcaggtgtgtgtgtgtgtgtgtattgattgcctgtccctgtctctctgctgcaggcttcagtattctggtccatctcttattactcctctcccttcgccttcttctacttgtacaggaaaggtcagtgtggtttcaaaggtggtggggtagcaaatgggcaggttgttggcagatgagccagctccctaaagaggagaggggacctgtgaagatggcttggcttccctcttccatcaggcatcttcttcctcttagggtatggctgttccaaacagggagtgtggggtggaggttggggctgaactgggaagaggagctgagggacattgcggagagggtctcacattgtccctctcccttcccaggttacttgagtttgtccaaagtggtgccgttttctcactatgctgggacattgctgctacttctggcaggtgtggcctgcctccgaggtaggtggagaggaaacctggtttgaatcttatctgtcactgtcactggttaaaaattaagtaccttgtgcaaatacattttagtgatgggcctccgagagggaatcattgagaatggtttaaggcatgatcttttccttaaaagacttgggttataaatatgaaaaaataactgaaaagtaacaaaaaggtttgcttttttttttttaagagatagggtctcaccatgttgtccaggctggtctcaaactcctgaactcaaagtgatcctcccacctcagcctcccgaagtactgggattatagatgtgagccactatgcctggctgcttttatctagaaaagatgcatataccctacaacaattctatatatgtatacatactaggaaaactcctgcacatgtataaacaatatagatgtacaagaatacagcatacaacattgtttgtaataatcctaagctggaaacaactccagtggctacaaatagtaggatggataaaatatgttctgtgtggccgggtgtggtggctcatgcctgtaatcccagcactttgggaggcagaggccagtggatcacgaggtcaggaatttgagaccagcctgaccaacatggtaaaaccccgtctctaccaaaaatacaaaaattagctgggcatggtggcacgtgcctgtaatcccagctacttaggaggctgaggcaggagaatagcttgaacctgggaggcaaaggttgcagtgagacgagattgcgctactgcactccatcctgggcaacagagcaagactccgtctcaaaaaaaaaaaaaagttccatgcaatagccatgcaagagaacactatatagcaatgcaaatgaacaaactgtagctacgctcaacaacgcagatgaagccaggtgcagtggctcatgcctgtaatcctagcagtttggtaggctgaagcaggcagatcaccagaggtcaggagttcaagaccagtctgtccaacatggtgaaaccccgtctctactaaacatacaaaaaaaaattagccaggtatggtggtgagcacctgtaatcccagctattcgggaggctgaggcagtagaattgcttgaatccaagaggcagaggttgcagtgagccaagattgcgctactgtactgcatcctgggcaacagagcaaggctccatctcagaaaaaataaaatacaaaaaattaactgggcatggtggcacatgcctatagtcttaactgcttgggaggctaaggcatgagaactgcttgaacctgggaggcagaggttgcagtgagccaagatagcaccactgcactccagtctgggtgacagagcgagactctgtctccagataaacaaaagcaatgcagatgaatttctcaaatgttgtgttaaatagaagaagctaaccacaaaataatgtatgcagtatgttttcatttatataaaattcaaaagggatgtgcatgtttgaggtagaacaccgaagacaacaagggcatggttttctttttttttttttttttttttgagacggagtctcgctctgtcccccaggctggagtgcagtggcgcgatctcggctcactgcaagctccgcctcccgggttcacgccattctcctgcttcagcctcccgagtagctgggactacaggcgcccaccaccacacccggctaggtttttttgtattttttagtagagatggggtttcaccgtgttagccaggatggtctcaatctcctgacctcgtgatccacccgcctcggcctcccaaagtgctgagattacaggcttgagccaccgcgcccagcaagggcatggttttctcaaaagttaggagagtgattacctggggtgggggagaacagagtgggggagagccctgctgagaggtggctgtgttctctttgttgacctaggtgatagtcacatgaatgtttgctttgtattttttaaactgaatatatgttttatgtacatatgttgtatctcgcaatttaaaaaaataaagaggacagatcacctacccctagtgggtacataagatgacaaccaggtgatgggcgatgcttcaacatgggggtggtggggtcagggctggatggtcgcagttgggtccaggaccttctgcctgaggtgttctgccccctgatctctgcagggctgggctctctcctcagagaggccttccctgaccaccctgtctaaaagtagctcccactgctcagttttgtcttagttttttattttatttatttttaatttagaaaaaatacagaaaaaattagctgtgcatggtggcgggcgcttgtaatcccagctatttgggaggctgtggcaggagaatcacttgaacccgggaggcggaggttgcagtgagccgagagcacatcattgcactcccgcctgggcaacaagagcaaaactgtctcaaaaaaaagaaaaaagaaaaaatacagaaaagtccagagaacaaaatataaaagcctttttaaattttttgatgtatagttttgtgattttttttttatatatagttttgtgatatttgctttaaatgctttctgtcaacaaaatactaaagcaccacagttagggttggagttcccattggaatcctttcagtcccatcttcctctttcctcagaagtaataattgtcatttggtgtgggttttttttttttctggcacatacttttatgaaacatatacctcagttcctcaagtctaagctgccatcaattgtaaaatgaattctaatttcagagttttcaagggttaaaaaatatacattttagaatctatgaaatatggtatctataagcagtatgtattattttgcacattttacatttttggcataaatgttgtacaaatcattctgcagcacacatcattctctcatcatatcgttttgggggaataccattgatgacacataaagttctggttcattcttgttgtattttctctgtagcacttatccctctctgaaatgttgtttattgtcttctcctggctgtacctaaccccaaccagaatgccagctctctgagagccaggagctgtgtatctcatttcctgctgagtctcccgtgtgtagtacggtgcctgtctgacacacgacacctgccaagtcagtgaggagagaagttagggtttgaggtggctcagcagtgaaaggagagtggatgcaatcactgactgtgtaagtgaaaagagagaggagagagagtcagcactgagagttgcttctgcttcagaaaggaaagcagaaaggaggcaggagaggaactgttcaggaactggaaggagtcaaggatgggcccaggaagcagaggcaggaagaatcttgagggacagggagaatgctgagtagtacagttgaagagaatgaggatagaagagtcaggaattcagtgaggaagtaattatgggcaggagtcggagactctgaagccagatggcaaggggctagaatatacagaaaagaggcagaaagcaaacattggagaagaatggcagtgaaaaatagagaaatttgatattcgcaagggagaatagtattatatgatagtgtttaatagtgtcatttaataggttatatgacagtgtttaaagactgaggaagaggaacattctggaagatggtaggttaaggattgtctataaagacacaaactgcagaagctagggagaagaagcgtcctgtagccagttgctggatttggaggaagggggttggctcacatctatttctccgcatcctatgccctcagttcctttttctttcactttttcttacagggccttcttctagcccatctccaattcttttcctaaaacctaggctttctgcttcccagttttcctagcactgtttcctgtcctttttctaccaggcattggccgctggaccaacccccagtaccggcagttcatcaccatcttggaagcaacacatcggaaccagtcttcagaaaacaaggtgagaggccctaggaaaagtgccacacaggcacccaatagcagctttctcagttgtccctcagagcaccagacactggcttctgcaggaagaggaggtgtgttttaccacccaccacactgggtgtttgcttgcacattgctgtatcccttctcacctccattagtgaactgtccacctgaggaatttttcctccctaccacttctaatggaatattctgctagaacaatcttccccctccctcacctgtaagaactggctaaactagaaacattccacaatgtttcttttttctttttctttttttttttttgagatggagtttcgctcttgttgcccaggctggagtgcaatggcacgatctcggctcactgcactctccacctcccaggttcaagtgattctcctgtctcagcttcctgagtagctaggattacaggcacgcaccacccacaccctctaatttttgtattttttgtagagacggggtttcaccatgttggctaggctggtctccaactcatgacctcaggcgatctgcctgccccagcctcccaaagtgctgggattacaggcgtgagccaccactcctggcctctttttttttttttcttctttgagacagagtctcactcttactcaggctggagtatagtggtacaatctcagtttactacaacctccaactcccgggttcaaacaatgctcatgcctcagcctcctgagtagctggaattacaggtgcacaccaccacgcccagttaattttttttttttttttttgagacggagtctcactctgtcgcccaggctggagtgcagtggcgccatctcagcttactgcaagctcggcctcccgggttcatgccattgtcctgcctcagccccctgagtagctgggactacaggcgcctgccaccacgcccggctaatttttttatttttagtagagacggggtttcaccatgttagccaggatggtcttgatctcctgaccttgtgatccgcctgcctcggcctcccaaagtgctgggattacaggcgtgagccaccgtgcctggccaatttttgtatttttagcagagacagggtttcatcatgttggccaggctagtcttgaactcctgactgcagacgatctgcctgccttggccttccaaagtgctgggattataggtgtgagccactgtgcctggcccacagtgtttctttttttttcttttgagatggagtttcgctcttgttgcccaggctggcgtgcaatggcatgattccagctcactgcaacctccgcctcctgggttcaagcgattctcctgcctcagcctcccaagtagctgggattacaggcatgcgccaccacgcccagctaatattgtatttttagtagagatggggtttagctgtgttggtcaggctggtctcaaactcctgacctcaggtgatccacctgccttggcctcccaaagtgctgggattacaggtgtgagccactgcacccagcccacaatgtttcttagaaggtagttttctctgtatcacagcagctcagttctataaatgtttaattttgttgtatgcattgaataccatgctatccttgtttgtggatgggacaaggtggacaggtgtgtccactcctatgcctgggagtacagcatggtgccaggagggagaaaagctagggctcagtgtcttgggaattatgccaagccggctggtgctggactgtgattatctttgaggatgggctttggggccccatagagctcttttctgttatgggaggtttctaggatcaaacagctatgaccaccatcatcacattcctggctactccacactatggagctgcgtaatgatgccctgtactatgctactggctgaagcatttggcacacaccctttctgatcctcacaacagctgagtgaggtggcattattacctttatttgtaaatgtgagaaaacagaggcaaaaagaggttaagtgacccattcggagtcatagagcaagaaagtggctaagtccagatttgagagcaggtctgagcaaagcctgcctgaaatttgcttttagtcatcttgttttgttttgccatttacctttttgtataatttttctattgctctctgttagtcaaattatttttgaaatgtcaaaaaatttctgtgcagaaaataaaaaccctcaaaatagagtgctaggagctcagggggtgggggacgaatatagtcaagtattaagacacagctaggccgggcgcggtggctcacacctgtaatcccagcactttggaaggccgaggcgggtggatcacgaggtcaggagatcaagaccatcctggctaacatggtgaaaccccatctctgctaaaggtacaaaaattagccgggcatggtggtggcaggcacctgtagtcccagctacttggaggctgaggcgggagaatggcgtgaagccgggaggcagagcttgcagtgatccgagatcgtgccactgcactccagcctgggcgacagagtgagactccatctcaaaaaaaaaaaaaaaaaaaaagacacagctcccactgccgtcaaaaaacgtggagctggtgaggtggttcatgcctataatcccagcactttcggaagccaaggcaggaggatcgcttcagcccaggagttggagaccagcctgggcaacatagtaagaccttgtctctaaagaaaattttaaaaattagctgggcatggtagcacatgtctgtagtcccagctactccagaggctaaggtaggaggatcacttgggcctgggagtttgaggctgcagtgagctatgattgcaccaactgcattccagcctgggcaacagcacgagaccctgcctcaaaaaaaaaaaaaaaggcatgtggactggctcagtggggtggcccgaggttcggatgggctgtagggcaacactgatccatggctgcaggagttgaggaagggatgtagttgtgaggatggaagtcagagcttccttcaacgggtggccccacatggcagaggagcccactgtgggcgtgacttccctcctctctgtctcactcaaccttgggtctgtcagtgtgatctgctgggagatttctaagcttctaagacagcaccctataagggacccaggtggggaatagaccgtgaccagccagcgacccctactacccgtcactcaaaagcactagcaccttcagccactcctcctggggatgggtcagacttagttttttagaaaagcagagtgttaggttcttagcttggaagagggcagacaggccagtcctgatacctgatggggcataccatctcccctgattttctggtcctgttagaattttccatctgagaattgggagggtattgacctccgcttggtttccccatgatgtgtggggatcagacccctggataacgaaggtgttgttgagggtgggtaggagagcctcccctgagttctcagtacccctttgcctctcgtgcccactgcagaggcagcttgccaactacaactttgacttccggagctggccagtcgacttccactgggaagaacccagcagccggtgaggccccagttcttttgctgtatctctccccttagaaccattccagaaaatctctgctctgccctcccacctccatgccctctcaggtcacagtgcctgccttccaatgccattatgtcgttcctagaccccactgttctccagacctcagacatccagcttgctgctcctgaccctatccttccctgcatctttcccttcctcaggaaggagtctcgagggggcccttcccgccggggtgtggccctgcttcgcccagagcccctgcaccgggggacagcagacaccctcctcaaccgggttaagaagctgccttgtcagatcaccaggtgggaaacagcagcgaggagaggcccactggggtggaggggccatttcaggagtgctctgggagtgggcgctccattgtaaaatagctgtcactcattgggcctagtgctgtatggtttgtgtagatcatttatggcaaagtcatttttatccatatttatgtttgaagaaaagaggctcagagaggtctggagtctcaaatgtagtaagtaaagaactgggatatgaacaaaagctccttcagtgaggctgaaaaggagcagtgggggtggggtgggggtggggaggacacacacttgtagctagggcaggctctggtagcatctgtgtacccatcgtggcccctctgccctgttgttattccaccttggctccgggcccctgtgtgcctcagtgtctgcacctgtgatgaacctgccctgcaaggttgctgaggagattaagtaaggtaacatgttctgaagggctcctgccttgcctgggtgcttgagagcacatggtaaatcccaaataaagctcagtcgtgggtactgatgatgtcagaaggaacggaaataaccacctatatcttatagtggaacagacactgggaattttcttttgctgggagttaggaggcagcttctagaataccaaggaacagggtggacttagtggttggttgttgacagtgtgctaattagtcagggaggcaagccatatttgaggttttgaattataaccatcattttttaaagcattatttatttggggacctttaatatgttgtacttatattttaacagaatcataatctgatgataactttgcatttacttattatgtatagacagttacatcataaaactctcagaattctgtacatacaggatatgtgtgcactgagccacaatataaaatgtttatcttacaaaggttgcagtaagaaaagtttgcaaaacactagcctggtacatatttcattaaggcttgaaagaggaaagtaaagctgtgaaggtcaggggtaaagcaggccttacagtctgtgagtgctagggctgggatggtccccagcacagtccccaggcctcaacagggttggggtttgttaacctgtgttccccacagctacctggtggcgcacaccctagggcgccggatgctgtatccaggctctgtgtacctgctgcagaaggccctcatgcctgtgctgctgcagggccaggcccgactggtggaagaggtgaggcttccctgcccgcacatcccctaaagccctcccctctcacccccacccaccccgccccacccctgtgatgtggcctcctgacccttgcatcttggccattgcgtcttccgtactcagtgtaatgggcgccgggcaaagctgctggcctgtgatggcaatgagattgacaccatgtttgtggaccggcgggggacagctgagccccagggacagaagctggtaagagggagcagagagcccagaggtggggtgagtgtgaggaaggcagtagaggtctggggaccccaatgctatagcacctccctgaaggaaccactactggggataatctcatgtcctagctccacgctaaagaccttgtgatgtagtgaaaccctgtgatagagaaacagatgaagtaggagagacgttcaaggacgagaaactaatattaatagttaccactttgacagcacttcacacttatatatatttaattctcatatatatatgaagcatatatatttaattctcaaaagaatcccgtgagataggtactgcttatattagcccattttacaggagatgaaactggggcacagaaaacctttcctggacctcacagtaagtggtagagctggtatttggacccaggcagcctggcctcaaagtctcctacctccatgaagcagccgtggaaagagcgctaagccaggagtctagggagctgggttctagtcctggctctgcccatctgttatgagagttcatgcaaatcccaccattcgtgggtttcagcttggggcgccatggcattacagtttatctgaccataagactggagctcagagagggatagggagagcaatcagcataccacacaatagcaatggtcacagaagataacagacccgaaaacgagaaaggaaaaacatctccatagtccccttcctgaaagagatccagctggtaatcttccaaggaaaagacatggctgggtggtcgagcaggtcagcctctgaggagtatttgtaatccctttgcttctcctcttatggaccctgtggaatgagaagcttccattccccttggagaaaacagaaacctgccctttcctcttccctgcaaagctcttcatgggctgccctccctgcccaaagggagtttttcagtcccaacttggccccccagcccttccttcctgcctccttcctaggtgatctgctgtgaggggaatgctgggttttatgaggtgggctgcgtctccacgcccctggaaggtaggacggtgactcagcctccttatctccgccctttgaaagggaatgtccctgcctcccacactgacctgacctcccctggcctctgctttctctgggtgaggttttgagtctctcagctttagggaaaagtccactcgccatttgctttgataaccttacatccctcccctggcctgtgtccctagctattatgcttttcattctgttccattcccccaccacacaccccacacaatcacatgctgctccctgtgctgcctcagaacctctggtgtcatctcctatttctgggaaggcttggagttatttgcatctaagctggggggtacttctgctcttccttcccccagggatggagaaagggctgtgggccacaaggtctcagtccctcctccccctgtgttacagctggatattcagtcctgggctggaatcatccaggctttgctggaagcacggtgagaccatctcaggaatcccttccttttcctgaattatgtctgtttccctctggtcagccattggagggaggagaggggctgtggatttcttgaaggcgtcccactcacctgagggctggggtctaggaggttgtgaaggcagcattgggagccatgcccccatccccacagtgcggggctagcaggagaggaggaggtagatctcattgtacacatccgtcttctggagagaacaacctctcctaccatcccttccttctacaccttctctgcctgtcataggtggctgcaggaggggtccacgttgggagggacaggtgagctggcctttggtgctgacacactcctgactttgccctttctcctgcagggggtgccattcccgcagaatgaggctaatgccatggatgtggtggtccagtttgccatccaccgcctaggcttccagccccaggacatcatcatctacgcctggtccatcggcggcttcactggtaccagcctccctcccatcccccactgtagacacattcatgaccacccagccccacccgggagaggtggggaaatggggtggggtggaggctcaaggaagaagagagaggaagtagaatctctgagtgggcctggaagaagctatcctatttgcatacacttcacctttccttcccctcttgtgcccagtcattaaaaggaaaagcagacccaggtcctgggtggggagatcagggaaagtgaatgtttcctgcccattatcttcagtgcactatctccagtgttctatccccatcctctccagatagttccctaaccaagtgaagtaggttaagaaaaaaacaagggataacatagggggaatggggttggcctatagggtcagtgggatgagagcatgggtggtggggagaaaggagcctttctcagttcttactcttcttccctgccctggtaccagccacgtgggcagccatgtcctacccagatgttagtgccatgatcctggatgcctcctttgatgacctggtgcccttggccttgaaggtcatgccagacagctggagtgagtgcagctcccaggcctgcccttcctgggaaggggtgggctggaactgggaactgttctgagatggctcccttttcttgggtggggagtaagtcgccccattgttggaagcaggaggactcctttgtctgggggcctcagttttctttctccgtgaatagtgaggacctttatgttgggcaagggctttgtctctgccatcccttcacctttatcccactctagggggcctggtgaccaggaccgtgaggcagcatctcaatctaaacaacgcggagcagctgtgcaggtgagggccggccagcgtccggcattgaacacctgccccccatacagctctgctgggcgctcaaaccctgaaactagtactaaagtgcaagttggtaaaaggccactggctcacatcctgagtgaccctgccaccacctcaactggcctaacccctcccaggtcccctgggactctggaccacctcaggatctggcaaccaaagggttaaggcctggcacggcaggggtctcccagcagggccagactgaaccatgccccttaaataatcccctctcacccctgagtgaagggctaggtcaagggctgtgctatagcaaggggagggtaagaatgctaccagtgcagggataggggtgggccagttgtcacccgtctccctctgagctctcccttcccactgctctgttctctgaagataccagggtcctgtactgctgatccggagaaccaaggatgagatcatcaccaccacgtgagtgcgtgggaatctcggccctcaggaaccccagagatggccaggaacttgtcccttctacctctgcccaccagaaacctgggtatctagacccttcctcctaacctccagcccctccagggtacattcttctcacccccagggttcctgaggacatcatgtccaaccgaggcaatgacctcctgctgaagctcctgcagcatcggtgagagccagggtgtgtgcgcgctgggggcagtgtacacacacagatactgataccagcacagggaaggagggaggaaggttcagggatggtgaatgaaaaaaaatcagccctgacctgtcctggcacttcctccgtaggtatccccgggtgatggcagaggagggtcttcgagtggtgaggcagtggttggaggcctcctcacagctggaggaaggtgagaagggatccagtgaggcttggggcgggggcccagcaaggtcaggttgctgactggctgtcatctctctccctgaccagcctcaatttatagccgatgggaggtggaagaggactggtgtctgtctgtcctccgctcctaccaggcagaacacgggcccgacttcccctggagcgtgggtaaggagctcctggggcaggagagagggtgggaagggcctaggaaggggatgaatacccagatgtgtggcctattttgagcgcctcctctctgcaggggaggacatgagtgcagatggacggcggcagctggctttgtttctggtgagctaaggagtgggaagtgggaagggttcttgaatggccagggctcacatagggggactggggataccctataagcattggaagtggcagcttttgtagagtgggtggtggatgcggaagtggagggtggggagggagtccagtggctgcccctcccaacagtgctctgtaccccacctgtcccacctcctttcctcaggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatcaggctaattgtataacttctcaagtgtccagggagccaggggcaggtagtggggagagcagaggccccaaagagctgggctttgggaaaccctaactctagacaatctagctaatctaacccttcccatctctgtgtccccctaggccttcagcccctaacctgagctttcctcaggcagcaggtccccaaacctccccggtccctgatgtgcctactgttatcacaactgtgcagcctccctggcccctcccgcctccttcttcagttcttcctgcatacaaccaccccaggagcccatggttgccccctcctgcttacggctcatgagctttctaggatccgatttcacctacccagtgcttctgctggtttccaggttcaacctgcatggtgttactagcagtacccccaattttcattgctcacctcttgttatcttggtgaagagtgaggaagggcctgctccccacgtcttatgcagcaaaccctgcacacccaccttgccatgtcatcaagtctctgtcctcacagcctttttgcagttcaacaaacacaggccctgccagggacggagggccaggtgccaaggactcatgtcttctcagagccatactttgccttttggacggctctgttaggagaagatgcttaggttgtacctgaggaaattggttccctataactgccatctatctctaactttggaccttgtggaacacagtgaataaatccctcttccacccattggtttgttgcctggcagttttttttatttttttggagatggagtcttactatgttgcccaggctggagtgcagtggcacaatctgagcttgctgcaacctccacctcccaggttcaagtgatcctccagcctcagcccctctagtagctgggattacaggtatgcgccaccatacccagttgatttttgtatttttagtgaagatgaggtttcgccatgttggccaagttggtctcgaactcctgacctcaggtgatccaaccgccttggcttcccaaagtgttggggattaaaggtgtgagccactgcgcctggccgctggccactttcttcatttggaaacttctcttttccagatgaaagaccccaaagtttatcgccctgagtccatttttgttttgttttattttgttggggatggttttttgtttgttttttgagatggattctcactctgtcgcctaggctggagtgcagtggcacgatctcagctcattgcaacctctgcctcccaagttcaagcgattctcctgtctcagcctcccaagtagctgggattacaggtgtgtgccactacacacagctgatttttcgtattttagtagagacaggtttcaccatgttgcccaggctggtctcaaactcctgagctcaggcaatccacccacctcagccgactccattctttttttttttttttttttgagacggagtctcgctctgtcacccaggctggagtgcagtggcacaatctcggctcactgcaagctccgcctcctgggttcacgccattctcctgcctcagcctccctagtacctgggactacaggcgcctgccaccacgcctggctaattttttgtattcttagtagagacggggtttcactgtgttagccaggatggtctcgatctcctgacctcgtgatccacccgcctctgcctcccaaagtgctgggattacaggcgtgagccaccgcgcccggccaactccattcttttgagcaagatacttaacgtgggcgacaatgttctaatgtcctagatggagtctctggctaaatttctgtgtcttctccaaacccagtgcatgaagctcttcttgaaaccccagggcagaggctgtgtgtgcccccattagcgctgcaactccttaagggaagatatactgagtctccactggaagtggagatctgagacttaatcaggtgatgtgatgcctgaaatttggagttagaagaggcaggtgaccacagctccataatgctccaccgttagcaaacaggtggatagctgatactggtgccctctcctctatcccattccaggggggcaaacgatgggaagtgtggaacatgaagctctggagccagctgcacagttctgaatcccatcctcccagatccaacagaagagttaatcccctgaaaactaaatttttgttcagctaagggaagctccttaaatgcaaagaggagctgggcatggtggctcacatctgtaatcccagcactttgggaggctggggcaggaggatcacttgagcctagaagttcaagactggacagggcaacatagggagactccatcagtacaaaaaatttaaaaattacccaggcatggtggcatgcacccgtgttccaagctactctggaggctgaggtaagaggatcgcttggctgaggatcacggtaggttgaggctgcagtgagctgtgatcgtgccaccggactccagcttgggtgacagagtgagactctgtctcaaaaaaaaaaaaaaaaagcaaataggggtgcccagtctcacctcccataccctggggacaaaggacacccctccctggacatggccattagggactctgctgaactgcccctactgccactttcccccatcttactgcatgtaattgtagacaacagtggatgacctgaggggcccttagatacctgaaattgggtagggaaagaaaggtaggctcaacatgtgaattctgaacccccccatccaggggcctcagcctacttcagattactccctatgcaataaggttcagagcagctgtgtttgttttcagaactaatccccacccaggggtggaagcaggcccctgtccactcctcaccctatatagcaaagttccagcagttccaggggatgatcagcagagatgcagaccttcccagttgctggggcgctggaccctgctatactggacacaaggtgaggcctgaaagtccaggcaccctgaggagctgggcaaactagcagaaaagatggcgctgggagaaaggaaagttagactctggacgggaaatctggaaagaagtggttcccagctgggccaaaaagcctcatcctacgccgtctcatcgacctgggctccaccctgagtgcctccagtgtgaggtgctggactggctctgtgctgcctgtttgggttgagggtttgctcctaggagaggcatgtatttctcgtacagctgtcacaagcgagtgagggctccggaggtggagggcccaagagggtggggagctcaggcgtcagtgatagccagatttccatccatcggtccgtccgtccgtccatccatccatccatctatccaatcaacaagccattccggattcttcaggaatccagtcattcatttatatttaggttaaagaccctctctctggttcctctctagaacgcaatctcgagccgctcccccaacaaaccgtggccctctcccgaccgggtcatctacagccccgcccctcgtttgcctggctccattcccctaaccttggcgttctgtcctcaggccccgccttctttgtttcgtcactcggttgcttaccctcaggtatcccttaactctaggtaggagcactcagaagggacaccgtcatctgctgctgtcgccatggcgattattcaacgccctgcctcttcaccccaggaaaaccttcgcggaacccgtcaccatggaaacgaactctctggactcttagcgcgccctgggctggccctgctgggtggacaggagaggagcaaaacgcaacaaagacgggattaattactcggaggccgcgccccctccgaagaaggccccaccctgccccggcctcacccctccccgaaataattcgaggaaatattccgcgaatgctgggtgggtgtcttgccccccggttccctcaaggcccacggtcgcttgaattccacagcaagtcctcccggacctctcagggcaatcccctcccgaagcccagcctcagcctcgcaaagcctctagtcgttggccttttcgttgcgattatattcgagagggagcttcagagggcgccgcgaagttcccctgtgcttcccctttgccctttgccctcttcgcttcaagaggagcccctggctctcttttttttttttttttttttttttttgagacggagtcttgctctgtcgccaagctggagtgcagtggcgcgatctcggctcactgcaacctccgtctcccgggttcaagcgattctcctgcctcagcctcctgagtagctgggactacaggcaggcgccaccactcctggctaatttttgtatgtttagtagagacggggtttcaccatattgtccaggatggtctcgatctcttaaccttgtgatccgcccagctcggcctcccaaagtgctgggattacaggcgtgagccacggagcccggccctctgattctttttgtctatcactctgtgcactcattcattcaagacatttatgtaggtgccccgcgttcctctgcagttctccactactctggcttttctctaatacaatttattttgtgttattatttctttaagacagagtctcactctgtcgcccaggctggagtgcagtggtgcgatctcggctcactgcaacctctgcctcccaggttcaagagattctcctgcctcagcctcccgagtagccaggactacaggcgtgcgccaccacacctggctaatgtttttgtattttttgatagagacggggtttcaccatgttgctcaggctggttgcgaactcctgacctcgaatgatcccccaccttggcctcccaaagtgctgggattacaggcatgagccgccacgcccggctaatttttggtatttgtagtagaaacggggtttcaccatgttagccaggctgggtgcgaactcctgacctcaggtagtccacccgccttggcctcccaaagtgctgggattacaggcgtgagccaccgcagtccggccctaatatagtttttaaattcattcattccaaggcttttgggaggcgctcagtggcgtgcagtttcctctcgaatttctttcttcccgcagtctttctgggcgggcgtctcccgtctgtttcttcccatcttcccccttatcatcctgggactggataattcttgaatagtctgggaggtagcagggaacccgagttcggagcctcgaccagaacctccagacgggaaattggagcaggtggtgtcgttccaggacgctgaggaccacctcctcccctaacgcacagcccaacgatcctaaaagtaaaaaccctgagtttctgagtcaagactgagctggtggggtggggaccgagtaggcgtggatggggagcccagcgggtccccagcggagaaaatgggtgagacgcctggggccgcggtctccagaattcgcctgggagggagagtggcgctacggcgccgccttcctggggagccgcttcgggctccggatgtccgctggggcccgacgcttgggtcccgacgcgcggttcgcactttccaggtttcttccccagggaacagagcttgagcggggggccacccccccgtcctaccggagttctgaggtgcggtcaggcgcggagagcggacgcccagcgccagattctgtgggctccggagttcaggcccactgagccgcagctgagcacaggcggggcaggaaaaaggatgaggtgagggaaggcgctgggttcctggaaccccaagggagcactgagctgagtacgtatcgcttgggatccaggtgtccttgttttaggatgtctgacaggtgtccccagggtatgagaagtgggactgggcaccccctatttgcttttttttttttttttttgagacagaccacatgtttcctatcttggaaaatggtaccacttccttgtgcaagcctacccctgttccctcacccctcgttcagtccaacagcaaatctgtccagtcttctaactgtatctcaggttcattagccccgcttcctcgtccctgctcgtcttctgccggaccagtccgccatcttgtgaccggactcgggaatagcgtcctacttcccggcggcctccactcttgacccaaatgcaatgtgcagccatggcaatcttttataaacagaaatccgatcaagttactcctctgccgaaatccctctggtcagtggtttaactgtcgaggtgctcctggcagcactctgccctccccacatcattgctggtggacttgtctcccctactagactgtgccctgtgagggtggagactttgtgcagggttgtatccccagcatctgatgcagtgattcaataaacatctgtccaattaataggaaagacagttccttttctcattcccctattgctggtcccctgccctcaagcaggatgttatgccccagagtggctgtgggtgcgaacattctgcccctctggctggtctggcactgatttccaccctgagctggtgttgcctctctccttcctcttggccaacctctcttccaccaatataagcccaaactggaggccagcaggcagtcatgcgttttatggcaggccctgcagggagccagagtctgggtcccctgtgcttccacagcagcccccaagccctctacacggtcctcttaatagtgctggtcatgatgagcttggtgtttggtaagtggctccaagggttcagaagggtctcctggcctggatggagaaacccacagacaccaagtgtctgggtacacctgtccaggatgctcaggtaaacccatgcaggaggagagatgggacagatgggtttggtagggaatgcctgctcatggactgatgtgcaatctgaagatttttaaaaatttattattattattatttttgagatggagtctcgctctgtatcccaggccggagtgcagtggcgagatctcggctcactgcaacctccacctcccgggttcaagcgattctcatgcctcagcctcccgaataactgggattacaggcataagccaccaagcccagctaatttttgtatatttagtagagacggggtttcaccatgttggccaggctggtctcgaactcctgacctcaggtacctgcccgccttggcctcccaaagtgctgggattacaggcgtgagccaccgcacccagcctctgaaggagatttctagtgaccaccccagggctgtctcacttcacagcagtgacctgaatagagatactgaaggaatcctctctggatctgagggcaacatagaatagggagggttagggagtgtgctggatgagaaaaccagaatccacaggatagaacaagactgagtccagcctgctgggctccccacttggctgcaaagcaccagccacagagacacaggattcaaagtgttggtttagcactttcctctgcctaacaccaagtgctctgctgggtctggggatttgttaacatgtggtctggccttaggaccagaggaaaagggggatgtatgtgtatgcagttggggaaggaagcagagaattggggctttgatggttttctgagacaggaagggagggaggagtggggctgagtggcctggaatcaggcagtggtagggtgtgaggtagaatggggtgtgagtggggtcagcacttctctgtgttctaggtaagtttgttcctgtcaattgggaaccccctcaaccacttccattccccaaatacctgcgctgctaccgatgcctcttggagaccaaggagttagggtgccttctgggatctgacatctgcctcaccccagctggcagcagctgcatcactctccacaaaaagaacagtaagtggccttctcctgtcatgggcccagcactctcccaaacggaaactctctcagcctcctaagctgcaccccaagtcttgttcccataatcccataagacattgctccaatcctgtctttttttttttgctgctctgtcacccaggctggagtgcagtggcgcaatcttggctcactgcaacctccacctctccagttcaagcaattcttgtgcctcagtctcccaagcagctgggattaaaggtgcacgccaccacgcccagctaattttttgtatttttagtagagatggggattcaccatgttggccaggctggtctcgaactcctgacctcaggtgatccacccaccttagcttcccagagtgctgggattacaggcgtgagccaccgtgcccagcctctcttcccttttcttcagagccacactctgtctccacttccactaaccttctctcctcaatctgtagctgaatagcttctaccctatcaaggtgcgcagctttgacggggaccctccagatctccaggtgcccttgcctgtcctcaagctgtctgcttccgcatctgtctgcagttactgctggtgttgctcttctcctgcatcctccacggcttcttcagtctccttcatggagcgttttctctctgacccttagtggttcatgttcaccaaggtttggtccttagctgtcttcccacttcatatactcaaaagcagaggattttatctgctttgctggcttcaaccagcagccacataccacttccttctgaatctgaatgttatgtcaaaccgctctcctcatatcccgttgaccactggacatctccctcgctgaaaattgactccttcccgatgcctgctcttccaccgaccccccacctttcttaagttagcaaaaacgtaacacataatatgtgctaggcactgttctaaacacttgcaatccgctgaggcaggtattattactatgtgcattttacagatgaggaaacaggtgcagaaaggtcataaccttgcctgagtctcacagatgctgagccagaatttgtgatggctccagagatggtgctctcaacaaccactgcatgcagctgcctgtgttcaagtcctcttactacccttttaacatagccgatgcacagatgtgggtcaaatatcagagtatacaataccatcaaaccaaagtctcccgctactaccctaacccacctggctcccctgcacatgtgaccactttttttactttctggatgatccctcctgcaatcttttatgcacattccaccctgcacaaatatgctgtttactattttttcacctcttcccccgccccaacccaagatagtagcatcccactgtaaacattattccacatttaagttaggggaactgaatgttccgatatcagtttgtaaacagcttccttgttttattgacctgctgtatactactccatagcatgcgcatatcacagctgatttccccatcccactattgatgggcattttggtcatttctctcaagcagggcagcagcaaacatccctgaacatgacttcttgggatgcaggcacaaagatttttctctattatgtataacagcagcagacatcatcttattctcttttggtctgaaaaataaataacaatacacctccttcctgccacccaatctccaaaacatttcccagctttttctcacatggtcctatggtgctagttctcctcacttggctcagtaactcccaactccccctccaaccattacatttcatatggctcttttcctccagccttgcatgggaacttcagtggagttccatggctggtgaacactgggcatgtccacccatgcctaactacaggaatcttttctttttcttttttttttgacttatgagtgtggggatgagaggatttggggctcttcctggggacttccgtatcactggtgcccactgtccctccccaggcagcggttctgacgtcatggtgagtgactgccgaagtaaggagcagatgagtgattgttcaaatacccgaacttctccggtgtctggcttctggatattctctcaatactgcttcctggatttctgcaatgaccctcaaaacagagggctctatactccttagtgtgactgcagcaaactttggtgtaaaattccaccagtttccagccaccttcctgacttctatctgggcttggccaggacttctagtccctcataccagccctccttgcctccctccagccactggaccccagccttggctcttcctcttggttgacgcccttcagcacacttactgctactctgtacccccagccctactgcccaccaggtttcctctcttgtcccctagtccctggatgtttctcccaaataaatttgtgtgtaaactgtttggtatgtctctttcttctggtggaggtgaaggctgagggaggtgcacctgcctaactgccctaccatgggtcaggtaagggacccccagctctgctgagctgtcctcttgtcctgccttggtatgtgatttgctctagacacaaaaagagaaagaggaaatgaaagccctcctatggtgaatgccagaaagttagtgggcatcctcggcagtgctgtcagaccagagctgtgtgggggctaggggcgtttagagggctatgttggtgggaagggggctgcgaaaggaccaggcccaggtagaaggaggtgggtgagaaggccactctttttttgagacagtctcactgtcacctaggctggagtgcagtggtgtgatcttggctcattgcaacttctgcctcccaggttcaagtgattcttctgcctcagcctcccgagtagctgggattacaagcacatgccaccacacctggctaatttttatattttattagtagagacggggtttcaccagttggccaggctggtctcgaactcctgacttcaagtgatctgcctgcgttggcctcccaaagggctgggattacaggcgtgagtcaccccgagccgagaaggccactctcaaagagatgttagaccttattggagtcctggtctcttcaattctgggccaagttcttcagcctctgagggtgtcttccaggttgacctgctataaacctgggcctttctctgtcttatactgacgtcagaggtcatggagaagggtggacttagcaaggtgggggttggggggcacattaagggtttgtacctctctttgtacgccaactgcctcatgacttaattatcattggtttggtattttccgtcagagtacaggccacacagatttgttaacacgtgtgcaaaacactatataggtaaaagcagatgcgtacgatgccatttccatcaagcacagacagaactcatctaagctactaccagtcaggacagcggctaccccagagctgggaagagcacctgggagaggggaacagaggcaggcttggctgcaggtaaaggtcttcacgctgatttggtggctggttacacagatgtgtggtttacaaaaatccatcttgtgatatgtgcaagcttctgaatgttttaccaaaaaggtttgaaaataagtaaatcagccaggtgagcatggtggtgtgcatctgtagtcccagctacttggaggctgaggcagaagaatctcttgagcccaggagttcaaggccagcttgggcaacatagtaagaaccttagaaaaaaaagctgaacattgtgtatgcatttgactctagggcaaatatatttttttgagggggaaaaggccttaacttctacttgtgtatgcacatttacatgtgttttctcaatcatctgaggcactatccctacttgacaggtgaccaaggtggggctgaagagactgacatatccaagtggtagaggggctgggattggacctcccagccacaaagctgcactgcttttcagaaaaaggtttcataacccaagcactgggctgcaagacttggaagggcagacacctggctatactcatctgggagtcctgctgctcaataccaagcctgactcagagcagcgttatgtccagcatgtttatccagtgtatggaaaaggctgttgtatccatccttgctttctatacgtttgcactatttcaaaattaaaatattagcatgaagatccaaccactgcagcccaacatcagtgctctcagcactttgcccctcaaattgggcccctcgagagggcatcctggatgccagaatccttgaaaagaactaaggaatggcaggagtccagggccccagcagcaggtaactctggcatgtggctctgagttcctgagtctttctggtttaaagagaaagtttctttttttttttttttggagacagtctcggtctgtcacccaggctggagtacagtggcacgatctcggctcactgcaaactctgcctcccaggttcaagcgattctcctgcctcagcctcctgagtagctgggatcacagacacgtgccaccatgcccaactaatttttttttttttttttttagtagagatgggctttcaccatgttggtcaggctggtgtcgaactcctgacctcatgatccgcctgcttcggcctcccaaagtgctgggattacaggcaagccaccgcgcccaggcttttttttttttttttaagacagagtttcgctcttgttgccctgtctggagtgcaatggcgtgatctcagctcactgcaacctacacctccccggttcaagcaattctcctgcctcagcctcccaagtagctgggattacaagcatgagccaccatgcccagctaatttttcatatttagtagagacaagatttcaccatgttggtcaggctggtctcaaacccgacctcaggtgatccacccacctcggcctcccaaagttcagggattacaagcatgagccaccgcacctggcctaaagtttcttttcttaggtgaaaagacctggcatcatcagggtctaactttccaggttttgtagggtatgtttaaggctgggaagaatcacagtccccatgctttgatctccagctaagcagagggtggggagggatgtgtgccctttacaggaggccgagaggaagcgacaaacgccaagtgcaatggagagggctctgcaatcctatttggatcccaaacctcactaacccttttttttttttttttttttgagacacagtttcactcttgttgcccaggctggagtgcaatggtgcaatctcggctcatcgccacctccaccttccaggttcaagtgattctccggcctcagcctcccgagtagctgtaattacaggtatgcgctaccaagcccggctaattttgtatttttagtagcgatggggtttctccatattagtcaggctggtctcaaactcccaatctcaggtgatccgcctgcctcagcctcccaaagtgctgggattacaggcgtgagccactgcgccaggcattaaccctctttaatctgtgtttacctgcccacacctgagcctgaccccacaaacaatgtgacacagttttagcccagtcccagtttattgtggaggaaaatgggggacatggagctgagcagaacagacccttccctctcctctcacaggcccctagggagatgggtgtcaggactcagtgaagtgaaatggggccgaggaagccagagactgacaagagagcaagagaggacaggaggcagaacaacactaggacaggcgggggttggtggagacagtgaggcagggacacaaaattgccaagtcaggacatctgcacagaattctattcctcatccttttttttggagacggagtctcactgtgtcacccaggctggagtgcagtggcgcgatctcggctcactgcaacctctgcctcccgggttcaagtgattctcctgtctcagcctcctgagtagctgggattacagaggtgtgccaccacacccagctgatttttctatttttaatagagagcgggttttaccatgttggccaggctggtctcaaactcccaatctcaagtgatccgcccacctcggcctcccaaagtgctgggattaccggcgtgagccaccatgcccggcctcctcgtccttcttgctgctagttcagtctggtactgggtcttagagacatggacaagacaggggaaacagagctagatgtcaataggcaggtgactggattgagagggatgggggatactggaacactcagatgatggggaaggaatggaggaaccactgtgcctttctcaggtcagcctgtctgggcagaatccacactagagattcttttctagggggaagaacagcaccagagctcagacaggcacagtggctcacacctgtaatcccggcactttgggaggtcgaggagggcagattacgaggtcaggagttcgagaccagcctgaccaacatggtgaaaccccgtctctactaaaaatacaaaaaattagccaggcgtggtggtgcacgcctgtagtcccagctactcgggaggctgaggcaggagaatcgctggaacccgggaggtggaggttgtagtgagcagagatcatgccactgcactccaccctgggtgacagagcgagactttgtctcaaacaaacaaaaaaacagcaccagagttcaagagagaaaattacacaaaagtcatatagatgctagtggtacaacagacggaggcctaagaaatcacagtgaccaaagaatgtgggtgttttcagagagggcagtgcaggatgctgagggtgttacagaaagatatttgcactgtggaattcaggaagggtgaggtgtcaagagtccagcctggggaagaaccaaaagtcctgaactattgaggaacaagtacatgcggcgcagctcagcaaaagacaagcccaggttcagggacagtgtgaccatggggtccaggccatcaggctccgtcccagcatggaaattggggaggggcagggagaggttcagggcctggtagaaccactgaatctgggagtcagacagaggcagggccaggggcctgtcatggggctccggcagagagctctggagttgggggcttgaccaggagttgcaataatcgtactgacagcactgggcctgataccagtactctgcaaagtaggtgttgcgtttttcttggcagcggtaggaaatgtactgtccacagcctcgaacgatgaagcgaaccttgacatctgagggagaggggaaagctgataaccccttccaatagcttcccatagtccaagaacccctgctactgacttttcccatccttcacccagacctaatttacttctaacccagagtccttcaagaggctagaaaagtgagctctgctggccccctagaaccttagacccctccttccaagattcttctggttttttttgagacagggtctagctctgttactcaggctggagcatggtggcgcaatcttggctcactgcaacctatgcctcctgagtttaagagatctcccacctcagcctcccgagtagctgggactacaggtgcataccaccatgcctggctatttttttgtagagacagggtctcactatgttgcctaggctggtcttgaactctagagcttaagtgatccacctgcctcagcctcccaaagtgctagggttacaggcatgagccattgcactcagcccctcctctcttcttgtaccccatgcccggagcagccctgatctgtgagaggagagaagaccaagccattggctgccccaccagcagccccttcctgggaccttatttaccataatagatggtgatcaccatgcacagggatgagctgctgatggtacacttctctgagcctgaaatgcatcctacagaagggtcttctacgaggcagaagtggcacgtccggatgtcgggaacaggaactggggaggcagaaggagggatggaggcactgggtcactctcaaataccctgggccagtaggaagcccgattatccatggccacgctccacccccttcctggactcagttaccccttcctccctccctgcccctgggccccacttaccctttcctactgtgaagcccaccatgaccagcacacctacaagcatatggaccttcattttggaattctggggagatgggcagttcctgaggggatgccctgaaaccccaccttcctgtgaccatgctccttaatcctaagctgcagggtggttttgacaaggtctgagcaggagctgctgtaaatgcagagctatattcctacttggggcaggatcctggctgggaaggaagttattacttggcaggagggacagcatgtcctcacccacaacgtctggttcctgagtgtgggagtaatggcccagatggggtaatacctgggcactaccgggttctttatccagtgtctacctttgtcttgcataccctccaaagacctattccctcccttggaaagtccatgggttagtatctatctctgccaccatgtgctgtcttcgtcatacaacagggccaatccccactgtgctgggacaacctggccaggaaatcaagcatccccatccttctgagatgagcagtctcagctccaccagcggcaggcacacacacatcactgagcagcaattccggaccttgtcccacctcgttccaccctttagttatactgactttaggctacttttcctttagaactaaaactaaaagatggagctgctgattaagccccttacagtataaacagacagtcatagatatccaaacaaatatttctcatctttgaaatatgctttgtcttttccttttgaccttgcatttcatcacacgcagtcctaggaattctgttctgctccatactaaaaacaccacccaatccactgagcacaaatctgtcctggttttcaatctggggagggtgggctgggccatgagggcccctggagtccaacacaccatcaccttcccttccccaacagcaagcaccagcagactagctcatggccttttcttctactttatttcatattcccaccacgataacgactcctttaatttaaactaaaaaccatacagggttcctgaaagggtggcaaaaaagaaaggaaaagtcaaagactgcaggacaggtgggggagggaatcagcgaatcgtcttgactgggctcttgaagttgctggcggcttggagctgcagctggtaggccatcggatggatcttgaaaccgtagagcctaggccagggcagaggtcagagaggcagcagcatgagccccatccaggccctgccagtcacctgcattcccacctccccacctgagctcctctatggacctgctcagagctaaagcctcgtggttcccaacttctcagctcaagaacattctacaataaggtaactcaagcacagataatcaaataactttcccacagtcactcagcagggagatgccctgattctgggagaagcagacctcaagaaagggccatgccctgtcctcccctctctgggggatcttgggcctttcctttgacccttaatgactctccctgctccctacctgggcacaaactggttggcaggtctcttgggccggtactcgggatgcaccatgaagagcatgtgagggaaaccagtgccgaagtaggcgccatccgtgtgatggtgtcttgatgacttgggtgtgtacacatccatgcacttggggcagtagagcttcaccatggcttcacctgggatgtctgaaaggcctgggagacagccagactcagcaggccaggtatccccctattcctacctaacctcccctcaggactcaggctccaatgtgttgagccccaactccttcccataagactgccacacggtgctttcctttcccttcttcaacactcaccaatgggaagcattggctggttctcacagtacacacgaggacagtaaccaaagtctccttgctggtacttttccaactgaggtgaatacaatggaaggggttggcaggtagatgtaaagaagaggcaactcccttcgcagcccaacccataccactctgtcccccactcctcccacctctgtccagaggccccttctctggactagatgggctctcaaacttctgtgttgcctttcttccaattaggcaggctacaaaccatcagagccatttgttgtttgttccttgaggaagaggcagtctatcacaactctctgattcaaggtctgtctccctccctgaaaacaatcccttcaggatgacccccaatcagaattcaattcccaggcccaagttctggggttcttcccctcttctcagctagcttccttaaacagggcttaaacatgacttcttgctgcaggaacctgtgtctcttactgctcagaaggaggcaggtaggagcagagaggcctcaccatctgggcgatgccacggttggtaaggatgtagcgggcgtggatcaatccataaagcatctcggctgcctgctcaatcaggtcactctggttggggttgtcttccagttcttcatctgaaacacagcccggccaaatgcaactacttgtttttcagctttcctaggtgccctgcccatatccaggggctgcgggctattcagtttgcctagcacctacttttgggccttaccccatccaacatctgggcatgggacccagaaacctgggcttctgacccttgcatcaaacgaagacagctctgccttcccttcacaccttttcagcctctgctccttgctctccctcccaactccctcctcaatacataactgcaacaatgtcaatgcagaagatgaaattctagactggaaggtgcaaagcaggagaaacagacaacaaaccagacccatgaggaaacgcattttggaataggtctgaattgcggatttagaaaacatgagaacaagtgatatacgtcacaaaactagacaagagtcaggtggaggatcaaaataaagcatgaatttggggttaaagaaatcagagaaccaaaggaaatttcaaaattcaggcaagtgaatagagatttgaagagaaaaatagtgcacgcacacacacaaaacaaccctgagggtgcctcaccaggctccaggtccaagatcatgtctagagcttgtcgatagtgagggacctgctcattgagtccagtaagattaaatttgtcctggatgtagtcttcatccacctgtcaggacatggaagccaagagggaacccatatcaaaatcctcatctttgacctgggcaaaatgctctaagtgatgccttatcatcaacacaactgcatctgttgtgcttgtttctcactcccaactcagcagaagtacttgtgtctctccctagttcacctacactctctcccataaaagctttggcttttcttttctaaggataagtagatacagcaatctttttcttagacattcttttcaagatctttgtccctactccactcctgtatcccgtctctaggaaccagttttgtcctctcagctggctaaggaaggtggaagctgaacagcatggtttctgaacaaaacatttcaatgtgtagcatttcagttttcctaaaggccacctgagacaagtactagcagtgccactttagtaacaaaagatacaggccgggcgcaatggctcacgcctgtaatcccagcactttgggaggccgaggcaggcagatcacctgaggtctggagttcgagaccagcctggccaacatagtgaaaccctgtctctactaaaaatacaaaaattagccaggcatggtggcaggcacttgtaatcccagctacttgggaggctggagcaggagaatcgcttgaacctgggaggcagaggtggcagtaagccgagatcgcaccactaccctccagcctcggtgacagagtgagacccagtctcaaaaaaaagaaaaagacacaaattgactagcccaacgttatattgctggacggtggcagactcaggacttgggccccagttttgccactttagcacaggttcgtcggggtttataggggggactctttgctgataggaagttttcaaatagcatgtaagagaacagtgcagaagtggaatatgtgaaggaacgtctggtgggaagatatgtgaagctggcaagtagggaggttgaagagaactcacttcacagaagaattcattgccacggagcccacagaaccaggaaatccaggacacctcctctgagctgctcatcttcacgtcagctagaaaaagaacagtgtcagtaaagctcaagttctccttccctgcctctggtatcctccctcctcccacattcggccctccaaccacgggagaattcggaaccaccctttcttaaagcaacccaaactctgaagcactcctctccagctcctctaatttacatctcagccccttttctttgaagttaaacattctttggggtcccaccacttgaaagaagccaacagatactttgacccaccagcccgacccacatccctggagctcccgaaggccagggccctctctcctctgtgtcaactccggcagggacctcgactcaggctccctaccaatacaagtctctgcatgacccccacgcctttcccaagggtttccaagtttatcattctcaagcaagaactgggctcctccttttctcacgggttgggggcgattgtcaggtccctttcaccggaatccacacatcccccctccgctcctcaggccacctctccctccttcgtgccggacctggtcgcttcctcccccgcccccacatcaaagtccggagaccccatgtgccgctcccagcgacaagggactcggagcagcgacgacttcagactcaccggctggacggggaccaggactggggtggggtagggaagttgctacttccagggaacggcggcgaccgctacagcgcaggccgcggacccgaccgcggcaggcgaagtggggtggggggagtggaaattagggagggtggggaagagggcaacacgcaagcgccaagggtcaggtgccgcggtggatgccgggacacggagtccccggtagagaaagaaactggctaaatgagagaaagcgaactaccaatcccaggatgacccgcgcacgacctggctgtcacgaaggcccggaggagggcgcttgcgggcggggcacaacgagaagccaccggaagcggaagccaggtatggcgttcggggcccgggagtctgggcaatacagttttgtgctcactgggtgaagaggctgacttagggcggggaaaggagggagccaggctggatctctttccgcagctctcctcacgttcccctctagtcccggcgcggcgctgctgcccaggggactggcctatcctcggccaatccgctgggtccttattgcctgttgggcccctagtgcgaatcagtcccgccagagacccttgacgggcatactgtttcctccgggctcctgcctcatgaggggagaggtgcggcttggctccgtgcgtagggacttgggtggggtggggtgggcggtgtgagaactggaacgtcccagtgcgctaacctgaggtggtgccagccattctgctcgtccctttgcacttctccatttccccttaggctctaagtgtgaccttcgaaccctggtcagagtaatggtgaggggcaggcgtgacgttatttcattacacggcttctcggcattccacaggtttccctccgcctcctgagggcctttcctaacccacagagtggattcctggctccagaaaatgggcttggagcgggggccacgttgaggaaggcgaagggcattgtgggggcgttatgtaaaagtaggaccccaaccgacagatcctagtgctcgcgccacctgggcgcgcggagctttgctcgtttactattgaaaaagttccagcgcgggaaactgaacccggagctttgcgcacgcccgagccctcaagtaatgtgggttgtggtttttgttgttgttgtcgccacgcatgcgtcttcgtgccgtgtggctatttgattgtgtcaactcttctgattagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtatgtcttacggggtgggaaagtggtttcagaaagaggctggtgtttattgttggtgaggatgggggtgggggccggacgcaggacctctggacaacagtctcatggagttttattaatctttactaaggagcaaagtcggtattgtagggttccatgtttttacgcaaagtctctctcccttaggccctgcagagtcctaagttgtggggttactttagtggcaggaaagtgtttttgactactttttctcatcccagcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtaaggggaaactttagctcagacccatgtctcattgtgttctgcctctcccagccacaccacaccagacgccccagcacagtgctgaagagttctttccttatcctcatgtgtaggttgacagggtagtatagtcaagtggttataaacatgagctccctggatttaaagcctgattccacttacttgggcaaacaacctaatgtctacatgttccagttttctcatcttagaaatgggggtagtaagaattgttgttaggattcaatgggttaatatatgtaaaatgctagaatagtgcatgccgcatagtatgcaatacatgaatgttagctatagtcattatgactaatgtccctccccttgcccaagagtttgctaggtctggttaccatttttttctttcaactattctgctctggatcccacaatggtttaaagaaatttgtttttaagacaagtcaagtgcagtagtgagaaggaggggaaaagtggagtaaggagtttgatctgtaactgagtgaacaattaattcagataactcaccaccacctttggaccagcctggatccctcactgttaagtaggaaggaaggcaatttgtcccttttttttttttttttttttttgagacaaagtctcactcatctcactctgtcgcccaggctggtgtgcaatggtgtgatttcagctcactgcaacctccgcttcctgggctcaagcatattttttgtagaaagcaggctttgccgggacatggtggcatgtgcctgtaatcccggctacttgggaggctgaggcaggagaatcgctaaggtggaagttgcagtgagccaggatcatggcactgcactccaacctgggcagcagagcaagactccatctcaaaaaaaaaaaaaaaaaaagcaggcgttgccattttgcccaggctggtctcaaactcctgagctcaaagccatctgcccgcctctgcctcccaaagtgttgggattacaggcgtgagccactatgcctagctggcaatttgttccttagcagaaaagctgaaaagatcctattctaccctgccagccccctctgaggcctcaactcttccccttttccttcccctgcccttaatgctttttcttctttctctgcaggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcacttttctggaagctattttgaggaagccaaacagaagcctgggagccacatgcaagtcccacctgagtcagaaggggcagcctctccaggtggcatgataaggtcacctccctgccaatctgggttcactttcaggtcccagaccctcctgggagtcccccacctattctttcaacccccctggaccaagaattgcccagcttcgtgcaagtctcacttcccccaggaggagttccctgactacagccaattcactgatttcacaaacataagtccatatactatgtgccaagaatacaggtaaagacattcccaaccctcaaagagttcacagctggagagggaaagtgccatgttatcaatttttttcttttttttttgagatgcagtttcgctctcattgcccaggctggagtgcaatggcatgatctcggctcaccacaacctctgccccccgagttcaagggattctcctgcctcagcctccccagtagctgggattacaggcatgccccaccacgcccagctaattttgtatttttagtagagacggggtttctccatgttggccaagctggtcttgaactcccgacctcaggtgatccgccggcctcggcttcccaaagtgctggggttgcaggcatgagccaccactcccggcccatgttatcaaatattataatgcagggtgataagggaagtcaaggcctctagagatgagaatgggtagggttttgctggaagaggccagtgtgataggaaggcccacgattatcaagcttgtacacttagttgaactgggaccagaactctagcccccaaatctaaactttaaacttctttgttccacccatttgtctacacttttctttcccacacttccccactctcccaccacccacccccttgtcttgctcatgccgggtggtaggcacaagaagagctcactgttgtgaaatccaggaattcaaatttgcagacgggcaggggagggctgttcaagtcgcaagactcctcattttttcttttctgggaaagcctttcatgaagtcttggatgcgaaatggaggagtggtgggggatgtggaaaagaacccaggggcagggggctgtagggggcgaccgagtttagggaagcatgagaaacccgggaaaatggggagctgggtttatattaaggtcctggtccttgctaatctcggtttggcggtccggcgcgcacagacagcgcggggtatacgggggcggtctattcgcagggtccgccccatgagctgcggcaccgcccccgcgggtccttccagtcctggtgcagctgcttccgggcttcgcggctcccggcggctccccaaggccgcggccccgacgctgggcccgggagcggtccccgcgcacagcgcccggacgcgtaggtcccgaagtaggcccgcgctttgcttcgtaactggggatctctgaggacatcttagttctgaccttgtggaggccgcgtctctgctgcgtgttcgcgggccagtcgggccactttgtagaaatcatagccctctaaatcaagggacgaacgctgctggctggagtttgctggacactttcattccacctcctaacaaagagaattcctattccttgaggtcccttggggcagcagttaaagactacacgatccaggagcacctaggacctggggccaccttcctgcccgctttattggatggagcactgcctccccagtttctgggacaccttggggtgtggccttggtgagtgaaacttggggtgctgcctgctgggaaggaaatccggaaacgcagagaggactctctggtggtgacccaggccttgtcagatctgagattcttggaatctcagattgtgggggtgtggatggtgaatgaatttgggtatgcccccctttaccccagaactgaagaggaagcaaactacttgccacacttgaggctgcatgactattcagagaagggaggagccacttctgaattcagagtaggactgcatcaccaggcaaatacctgttctgagccagaaagactctggcttctgaggagatcctgagagtctgagtagtgccaggaagcagcctcagaatttgggggcccattacacaccccagccatgttcctgcgacggcttggtggctggctacctcgcccttggggccgccggaaaccaatgaggcctgacccgccttacccagaacccagacgggtggacagctcctcggagaattcaggaagtgactgggatagtgccccagaaaccatggaagatgtggggcatcccaagactaaggactcgggggcattgagggtttctggggctgcttccgaaccaagcaaggaggagccccaagttgagcagctagggagcaaaagaatggattccctcaagtgggaccagcctatctctagcactcaagagtctgggagactggaggctggaggggccagtcccaaactcagatgggatcatgtggattcaggtggcaccaggagaccaggggtgtcccctgaagggggactgagcgtccctgggccaggagccccattggagaaacctggtaggcgtgagaagctgttgggctggctgcggggggaaccaggagctccctcccggtacttggggggcccagaagagtgtctgcagatctccaccaacctgaccctgcatcttctggagctgctggcctctgccctgctggccctgtgctcacgaccactgcgggcagccttggacacactgggcctgcgtggaccgctgggcctctggctacatggcctactgtccttcctggctgccctgcatgggctccatgctgttctgagcctacttactgcccaccctttgcacttcgcctgcctctttggtctcctgcaggccttggtgctggctgtcagcctccgggagcccaatggggatgaggcggccactgactgggagagtgaggggttggagagggaaggtgaggagcagaggggagacccgggaaaggggctgtgaccgtggggtgggggcaaagggtgaagagagtgtgggctttaggagaaaagtgtgaggcatgacccaaattgtaagcatagggacctcagggatggggaagaaacccgagtacgagggtgcagggccccccttcatacacaggagagaacagaactatttagggtgtttgtgtttatggacagtgagggcactgctcttggattcaccagctgttatttttgcttttacttttctcccaccttcagttttttttttttttccacctccactttttaaaagcaaaaaaaaaaaaaagtatgatggtggtgaataaagaccaaagggtcctctctacctttgaaaactctcctggggtggaggagaccagggcaggatagacagacctctgcagtaagagagtggttgggaaacccagggtgttccttggatctcaggatctgagccatcgagggaagagtggggctgctaggcaagtggattagggggtctggatagggccccacaggtgacagggagcctgcagggcggatctggtgatcatgggagccagagggagtggggacagtgcaggcagtattggcaggagggccagtgcagaagggctggtagctcaggcagtgtgggggaagcactgaagcctgtagtccccacttgggggctaggggtttgctcactcagcaataaataactgtgtcacatcaaatcctaaatataccactacaaagtgagagttactgccactctgttcttactgacaccgtccagctgggagtttaggtggtagaggatccagggggaatgttgaaatgggaggagtgggaatgacgtctggagacaaaccccagaatgagatgaggattgaaaaattatctttattatcttgagtgggagctggagctggaagtctccagcttctccctccaacaactcagctcccattgtacccatctggggacttagatgaagttacaggtcagttattggacagctcacaggcctctgtgatggggggagggaaaaagaaggacagaagggaagtccagggagaaaagcaaagttgatagtaatggggtgggggagaacgtgttctttcattccctgtgtcaaaggggagtctctaaggctcttttccctccacgtatgaccctctgccccctttatccagtgcaaactcagaaacctctcttttgagtagcccagaacccatcctgcctccctcaggtgacatcacagctcttagccacatccctctggtgacatcacacgagcctctttcaccctgtaacaccagaagacttggtgagtcctaatcctgttttatgagattttaaccccttaccttgattcctaggagtcaataagaaggctttggagtccaggcaggaagtcagggacttgaattcctccacacacttttcgggaggatgtggtgagcgatctggaagggcaaggtggggtcaggccagtcaaaacccctggaagcacctagctcttcctgggagggtgtcataggacccagagtgaggagttctcctgccctcccttgtttccctccaacccttcctgccttgtatccctactcactgtagaggagaaagcgctggtaaccctggcctgtctcattcagcatgattccacctgggcatgagctggaaaagagctcagtcttcatgtcagggcggcctgtcaaggcaggtgggagaagtatgagaacagagatgcagaaccaaactcaagggagggtgagggctgggaagaaccaaccttcagttctgagatctgtgctcccttcagtcaggtggtagatccatttccggggcacacagagcccatctttcctgcagaggtggtggtggcaaggaggaaagaatgagcatcaccccaaccatagtgtcccagcttcttttttttttttttgagacagagtctcactctgttgcccaggctggagtgcagtggcgccatctcggctcactgcaagctctgcctcccgggttcacgccattctcctgcctcaacctcgtgagtagctgggactacaggtgcccaccaccatgcccagctagttttttatatttttagtagagacggggtttcactgtgttagccaggatggtctcgatctcctgacctcgtgatctgtccgcctcagcctcccaaagtgctgggattacaggcgtgagccaccacgtctggcctgtcccggcttctatttactccattgtatttgttattgaagcccagctctccttgggtttcaagctaccaagcattggttaggcacatctttctccagagggcaattaatacagccactgaattccgtgggccaagcatagtagatataccagctaagaggccagctcttggtgggtggattctcacactttgggcagagactgaacccagtgatgcttctgcctccttaccactcacatgcggatggtagcacgaaggtggagctgcatcggggcagagccagcagccatattgaagacaatgttgtccacagggtcaaaagttgccaactcctccttggtgggagctgcccctgcgataaagtaccactggcccaagtggacctctgggaactggagagacaatgaagggagcaaaagagggtgggttccagcacaggatgggttcaacctcttcatcagtcaaaacagcaagatttaggggtagaggtgttggctgccttcctctttccaactggggattggatccatgacaaagagtcattaaatgacttttcctctttgcccctccccagtcaacctgggtaaccaccccaccccccaattctgccatgcctctgcattgatggccacagtactgatatttttcttcttgctttcattatcacaacactcacacccccttcctctcttcctttcccaagatggtctccagtcatcctaggccatccacccaagtccctcagagcctccaccataggcttcccccaatctcagtccatacctccttcccatccacgcccagagttgtcagttgactgtgctcagggcactggtagatggagttaaggataataccatagaagtagagcagagctgcccaaatttggtggaacatcttcaggcaggagggagctggtgctctgtgtgccttaactgctctctcccctactggctgctcagtccactctgctttcagctcccttgcgttcgacccttgaccctttcacctgctaatgagtaacttcaaccttgttttccaacccaaacctggattacttagtgtttgggacttcctccccctcttccggatgcaaccactccatagtacaccctggcatgtccagggtttctcaggagttatgaggagagctgagctgtccagggagaagcctgtggtctttgaacctgtatctgagctggttatttgttgcactgtgcagcactgaagggaagtagcttgactgggcctctcattcattcacttagcaaactgttttgaatcccaagtcccagttgtttcccaagaactagctaatccccggggacataaaaaaacgaataagacatagcccctgatcttgaagaagtcgttagagggaaaactagctgtgtagacaaaccattgcaatacaacttggtaaatgctttagaacaggtatgatgcaggtgctggggcacggtggattgctctctttagtttacaattagaaaaatatgtataccctggcagtgttcactgacacattcactcaacatttattactacaaagaggctatgtaatctggctgttagagaggatagatgttggtgtcaggcagaatgtgtccaaaccctaactacaggcagggcaggtagctcatgcctgtaatctcagcactttgagaggccaaggtgggcggatggcttgagcccaggagttcaaaaccagcctgggctacatggcaaaactctgtctctacaaaaaatacaaaaattagccgatgtggtggcacacgcctgtagtcccagctactagggaggctgaggagggaggattgcttgagcctgggatgtcgaggctgcaatgagccctgattgtgccactgcactccagcttgggcgacagagactctgtctccaaacaaacaaaacaccaccaacccctaactgctatgtctgttttttcatctgtaaaattggcaaatcatcaatcttataggattaaatgaaataatgcacataaagcccttagcaaagacttgcacatggtaagtccaaagtatatatttgctataattaatagtaatgtttgcaaagcacttagtttctggtgggtaataagttctcaaataataggcagtaagaattgccaaataggttgtccttggatagcaccaagtgactggagcagttaatgctgtgagagatggatcttcctcgatagattatttatttacttatttatttttaagacagggtctcactctgtcgcccaggcatgactttgacttccccggctcagatgattcccgagtaggaggtataggtgcacgccatcacgcctagctaattttttgtagacacggagtttcaccatgttgccccaggctggtattaaactcctgagctcaagcagtcggcccaccttagcctcctaaagtgttgggattacaggcatgagccaccacacctagcttgataaatttatatcccatggactgccacaaaaaatttgccgagggctgaggcttgcgatttagttaaaaaacaaacaaaatttgggtgaccagtatattagagtttattaatactgttctattttggtgtaatgtttgaatttttttttttttttttttgagatgggagtctcgttctgttgcccaagctggagtgcagtggcgcgatcttggctcactgcaatctccacctcccgggttcaaagcaattctctgcctcagcctcccaagtagctgggattacaggcgcccgccaccacgccaggctaatttttgtatttttagtagagatggggtttcaccattttggccaggctggtcttgaactcctgacctcgtgatccacccgcctcatcctcccaagtgtgagtcactgcgcccggccgaaaatttttgtaataaaaagctaaaatgtggttaggcacagtagctcacacctataatcccagcactttgggaggccaagtctgcaagaccaggctgggcaacatagcaagaccccatctctataaaaataaaattagccaggtgtggtggtgtgcatctgtggtccctactagggaggctgaggtgggaagatcggttgggctcgggaggcagaggctacagtgagttgtgattgcgccactgcactccagcctgggcgacaaagcgagaccctctctcaaaaaaataagctaaaatgttaacagctttttattggggcagtaaagtacaagtgctcgatctggagtcctgtaggcctggatttgtcaattctgacacttatgttcgtctaagtgtactcacttaaaaaatgttaaaagctcgttaaaaggctttttaaaataatacacaaaacccgtagtatatgggctggcacaagtgctcattaaacagctgcttattagaactcttaactaaaatataaccaggacctgggtataaactacgaatcccagaaaggttggacaccccaacagcgatgtgtctttctggaggactcgcagtttcgcggggccgaggcccttggcccagggcaggttaagagaagagggcacggagaggcggtaatgcctccacccccggccttcggaagcacgctggccggcctttaaattccccacggtcagggtcttgtctttctgtccactcggactccatttgctcccaattctcaaactcggaagcgcctcttttcttgacaagtcgtgcaacttagtagcacgtttacttttcctaaaacgtgtcatgtccccttggccacacaccgacgaatgtgacgcccacagcccttaaaacgcccacccggcagaaccgaaatctagcccaaccaagcaaccgagaacaaaattgaccagtgccgcccccaaacgcctactgaaagagtaacttccggaggcacagaagaaagggcgcagcgagggcaatagggtggagaagagttttagctggctaggacagtgccgcctgaaattatcagcctgccaagatttaaacatagatgaatgtggcataatcccccatctccaaagtccaaggtccatacgaccgtccatagcccctctcgaggcagtggtagagtcccagctggtgactgtttttcaggcatttacggtagccacctcaatcttctagcgctcaagcgcgcgcacagacgtgaacgccgccagaggggggagggggtggggcgatgcttaagtgtccacgcatccgtagtgcgacgcacgcaggcgtagtacggtcccccgggcgacagcggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcaggtttgggggagaccggaagtgacggtccgtggggaagtcgggggcggagccgcggggtggtgggtgtgtgtgtgtgtgtgtgtgtgtgtgtgtgtgtgtgtgtttggctgtgggttagttgtgccgttctgctggaacaccgtgggaaggcagtagacgcgggcagtcagctagcaggtctgtcgccccgtgagtgccgtttcgggtctatagtgagttaggagggttcgatgggcgtggcgcgcgtgcgcgaaaccactttctccgcagagtgtggggcgaccaccgctttcgcgttgtcccaggattttccgacctctggggcgcttgtcctgccgtgaccggtgatgacactagtctctggtctcgtgcttccttcctaatctgactggctccctgcttattgtgattggcgtcgtggagcccctcccacctctcgtcctccagctccctaagccgtcgatctcctgccctttgtgtttctctccctgtgccccggaatcagaagggggatggggacaggtgtgaatgtgtgtgtgtgcaggagaaactttttaggtattggggcagggattaatgctagggagtctttcgggtacactctggtctgggcaacagcgggccttccttccttcgttcttctttagagacctgtcggccatggagcctaatgatagtaccagtaccgctgtggaggagcctgacagcttggaggtgttggtgaagaccttggactctcaaactcgtacctttattgtgggggcccaggtgagacacctcactagttctggaagacacctttagcttttcctcgtttaggccccttagcctgagagatgagcttgattttctggtcaccagattttctttttttttcttttttttgagatggagtcacgccctgtcttccaggctggagtgcagtggcgcgatctcgactcactgaaacttccacctcttgggttcaagcgattttcctatctcagcctcctgagtagctgggattataggcgtgtgccactatacccagctgatttttgtatttttagtagagacggggtttcaccatgttggtcaggctggtctcgaactccttacctcaggtgatgtgccctcctcggcctcccaaagtgctggtattacaggcatgagccaccgcacctggcctcagattttatttttattgatccctttgttcgtattccagtagaacgttttctgatgttttgtgagtgaggctgattttgttctgtcctccacatggatagaacttaatgcagagggaaatacagaggaaggaagaatctgtgtgtcatcatcatgggtggaccccaacccaaagggacaggcatggctctggcctttgggaagggaaacagcacaggaaccctaagcaagtgtgtcttactgatagacattggtcaggtctatgctgtgttcttaaagggtagaaatcagaacccataatggagataggtccttgatagactgttgagtgaaattactaatttttatggcatagcttgagtctcttgagcttaaagccttggacatagctatctgtgtctttactcctgtaatacttggagacaaattgcatgtggggtggtccatggttttctaaaatgtgatattacctggatataagaaagccatatatagacttgtgattagatgtatataaatactctggtacttcccaagagtcagtttgtagttaggaaaaatatttctctttttgcttttttttttttttttgagatggagttttgctcttgttgcccaggatggagggctggggcgcaatctcagctcactgcaacctctgcctcctgggttcaagcaattttcctgcctcagcctcctgagtatctgggattacagacgacgcctactaccacgcccggctaatttttgtatttttagtagagacagggttttaccgtgttggccaggctggtcttgaactcctgacctcaggtgatccacctgcctcggcctcccaaagtgctgggattacaggtgtgagccactgtgctgggaccttttttgctttcttatcttcttagtctttcttcattaacctgataccagaccccatcttctttgccattttttaatcttggaaatcacaggagagtctggtaaataaactggtatcatcttgtgtttggaaaggggtcactgatgtctctagacacatactcccttggatgccagacagataatataatgtccatgtgttttttttttgtttttcatccgtgttatttttcctggatctataacctgagcttcattaagtttatttatttaattttttgagatggagtccctctctgtcacccaggctagagtgtagtgatgcgatctcggctcactgcaacctccgcctcccgaattcaagtgattctcttgcttcagcctccctagtagctgggattacaggcgaccaccatgcctggcttatttttttgtatttttggtaaaaaaggggttttaccatgttggccaggctggtctcgaactcctgacctaatgtgatctgcctgccttggcctcccaaagtgctgggattacaggtgtgagccaccgcgccaagccaaatttattgtctgtattttgacagctgttactttagtttaagggtttgcacagtaatgatctcacggtcaagacaaacgggtagtgattctgtggtggtttttacccctcacctccacaactcggttgtctgtctttgttcttcctctttcctccattctttccattcctgtgcatgcctcttcttttcagatgaatgtaaaagagtttaaggagcacattgctgcctctgtcagcatcccatctgaaaaacaacggctcatttaccagggacgagttctgcaagatgataagaagcttcaggaatacagtaagggggctggggaggcagttcagaggttggggctactgtctggagggatgaactgaggccatgggtttacctgttcatactatgttttggtgtgtgtctatttttctgcagatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctgtaagcttatgttccacaggggagggcttttgtgggtagctttggttgtggtagcaccagggaattaataagatagatgcttccatctttagattgggttcagggggccctgtggtgtgctattggtctcagtctttaaggagaaaaggaggtagggctccagggaatgaattggaggtgtggaggccttagtgttggcttctcccagaacaacttcccttaccctttccccagagtgacggctctgctgtggatgttcacatcaacatggaacaggccccgattcaggtattgaggggcctccgagggtcagggaaggggatctgggagaaggaggctgggaggtggggtggacctggctgagagatggctgggacctgatttagtaggtggtagaactcatggcttcatctgtaacctaccctgataaaccttctctcattgtagagtgagccccgggtacggctggtgatggctcagcacatgatcagggatatacagaccttactatcccggatggaggtaagtgggcaaggctggctagggtctctctccaccctccctctcccttttctctcagcctgggagttagggcttcactggccacatccacagggtttggccttcataatctagtcttctctgcagtattcattcttttgggcagaaaaagtatctttgtgaggctctctcatttctgccaatcctcttggtgcctggtatctggggagtttgtttcagacttagtctcatggcatctcttttcaattaaaggattctactctcttaacttgtggaggctgggaaaccaacttgtggaggaaaggaaaccacaatctctactctttgttagaaatttatttacaaatattacagatgctgtggccgggtgtggtggctcctgcctgtaatcccagcactttgggtcgccatggcagggggataacgtgtggtcaggagttccaatccagcctggccaacatggtgaaaccctgtctctactacaagtacaaaaattagttgggtgtggtggcacgcgcctgtaggcctggctacttagaaggctgaggcaagagaatttcttgaacctgggaggcggaggttacagtgagctgagatcatgccactgcactccagcctgggcaacagagcgagactctgtctcaaaaaaaaaaaaaaaaattacagatgcttattatgcatctaatttgtgtcagtcttatgctagttgctagcgagtcggagataaaattgcagagccatgccttcagggagtctagttaggatactttctctgttcagtctcctgtagagtaatcctctgcagcagtcttaccctgcctttggtatcctgactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaagtgagagatggagggaatctttagtgggtggggaatcctaagtgaagtatggggagaaggaaatgaaccatggcaagggagggaaaggattacttggaggtcttagttgaagggttagcattgaggggcgaggaggggctctctcggtataggtaaatgacgctaggacaggcagctgagaagaactgctgctctccctacggcaaggaaatccaaatggtatctcctgagcctgatcggaattctcctctgagttcacgaaggcctgctctctttcttagaattagtctttcaccattgtaggtgcaggattgtggtggggagggtgggagcagttcattttcttctccctatcctctcatgggtgggagtaaagaatagaagctttggctgggtgcagtggctcatgcctgtaatctcagcactttgggaggcagaggcgggcagatcacctgaggtcaggagttcgagaccagcctggccaacatggtgaaaccctgtctctactaaaaaatacaggccgggcacagtggctcacgcctgtaatcccagcactttgggaggccgaggcgggtggatcatgaggtcaagagatcgagactatcctggctaacatgatgaaaccccgtctctactaaaaatacaaaaaattagctgggcatggtggcgggcacctgtagtcccagctactcgggaggctgagtcaggagaatggtgtgaacccaggagacggagcttgcagtgagctgaggtcgcaccactgcactccagcctgggtgatagagcgagactctgtctcaaaaaaaaaaaaaaaaaaaaaaaaacaaaaattagccgggtgtggtggcaggcaacttaatcccagctacttgggaggcagaggcaggagaatcgtttgaacctgggaggcggaggttgaagagaatagaagctctgctggtccagagaaggattgggccagggctctgggagaccagggagaaagagggcacatgtggtccctgttgactgtgagggtgggaatctgaggaaggctttggctcattgccccttgggtttgtccacagccatccttcccctgcggagtatgtcgaggtgctccaggagctacagcggctggagagtcgcctccagcccttcttgcagcgctactacgaggttctgggtgctgctgccaccacggactacaataacaatgtgagccctttgatggccctgccctttctcctcagccccagtactcccaaaacagaacaggctgaaatgcagataactctttccctccctggaaaaacattgcaacagggccaggtgcagtggctcacgcctgtaatcccagcactttgggaggccaaggtgggcggatcatctgagattgggagtttgagaccagcctggccaacatggtgcaaccccatctctactgaaaatataaacattagctggatgtagtggtgcacacctgtaatcccagctactcaggaggctgaggcaggagaatcgctagaactcgggaggagggggttgcagtgagccgagattgcactactgcactctagcctgggtgacagagcgagactgtctcaaaaaacaaaacaaaacaaaaaaacacacattgcaacaaaacaatttctctctaaacctgtaagtgattttgtcctcccttacagagaaggtgataatctttgctgtaagcactgtcctcgtatcgtaccccttgtgcccctgaatgaatttagaaaatgtaaagtacaggagatcagtatatgatgacttactgattcatagtagtgttttaataggatgttccttatgtgaataagatataatttatttgcaaagatttggtctacatgtaaacttccaaggatataactgaaagttttggaggacatggtattctcagtaggcattattgcttttattagtgagatggactccagcttgatattttctgcctttttgtgtttggctggttgtgcgcagcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacaggtgggttagggggagtctggcctgagggagagtgaggggtgttgatagagtgacccagggtagctactgggcctgaaggaggttaggaaaggaggagactggaaacatggtgatgaaggctggagatactttagaggtttatcatgaggttttcttggttaggctcttgtatttttctcacatctgcctgtccatctgtctttttcagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaaggtgagaatagttgctggcgagaagagcaggatcagcatgatgagggaggttcatgctgaggtgtgagggaacagggtggggaagggagaggcacatgctggtggtggtagcctggggaccagagcagaagcttaagtagacagatgtggggggtgtgggggttggtttgtctttggaggtgtgtttgtgtggtgaagggagtacctctccctgtttagatggagggaaaggcaggctttctgattgggggattatgggcctgaagtatgcctgatctcagaaggatatagttaggccttggccctacctacctcagggccactgtctctgtctccctgcccagattctggcacacagcctggtggtgttccgagtgctcccactggccccctgggaccccctggtcatggccaaaccctgggtaagagtgagggcatcagggcaggctgagctctgggtagagaaagggaagggctgagtgggtgggttgaaggggtccaggttcaaggttacatcagacccgccccccaggctccaccctcatccagctgccctccctgccccctgagttcatgcacgccgtcgcccaccagatcactcatcaggccatggtggcagctgttgcctccgcggccgcaggtaatgacctggaaggggaggcttgggaggtagggcacagtccatggtggcagctggctggcaagggcctggccctcagccctcttcggtctgtctcttctgccacccacaggacagcaggtgccaggcttcccaacagctccaacccgggtggtgattgcccggcccactcctccacaggctcggccttcccatcctggagggcccccagtctctgggacactggtgagcaagggtcggggagttctagtgcgtaacagtctagggagagactcctgtggtggtgcatggaagggcaggtctgaaattctcccttgctctctatccagcagggcgccggtctgggtaccaatgcctcgttggcccagatggtgagcggccttgtggggcagcttcttatgcagccagtccttgtgggtgagttttcattcttccccactcagagtttaaactcctttcctagtctgctcactggcactttccagttctttccatattttcttggttcctgctttcctggaatggggctgctgtagtgtcttgtgtcttcaggtttcagctttttttttttttttttttttttttgagatggagtctcactctgttgctaggctggagtgcagtgtacaatcttggctcactgcaacctctgcctcccgggttcaagtgattctcctgcctcagcctcctgagtagctgggactacaggtgcacgccaccacgcccagctaattttttatgtttttagtagagaagggggtttcaccatgttggccaggatggtctcgaactcttgaccttgtgatccacccaccttggcctcccaaagtgctgggattacaggcttgagccatcgtgcccggccagcttttttcttttttttttaagttacagagtcttgctctgtcacccagactggagtgcaatggtgcaatccagtgagttaaagctcactgtaaccttgaactcctgggctcaaacagttctcccacctcagcctcctgagtagctagcagtactagctcctggctagtaattgtctttttttttttctggtagagatggggtcttgctatgtggcctagactcctgggctcaagcagttctcatgccttggcctcccaaagttgctaggattacagccaagagccaccatgctcagcccagctttctttttttggtttcttacagctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggtgagtggctggcttgccattcacctcatcttcctgtcccccggcccagccaggcagtggtaccttcttgccattatataaccactgggtaagagcccctagtgacatgttaggggaaggggccctgggaattcattgactctgaacctttcattttaaagatgaagaaaatgaggtttagaaaaagaaagtatagtaattagtgtcactgctttctgacagcctgttcagaggaagaggtaggtaagttgtgctgcctgactctgttaaatacctaccatacttctgctttaagcagtgaagatcagaatgtaactccccatcttcccagacccgttggtttgtgccctcttgatgccgtattatttccgtgtgtcttcattctcacctcactttctgttctttgttctttctttatttgccaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggtgagcaaaaaggatgctttggcttgctccaggaaggggcagccagaggaatgtagatggccttggtttaggggtgttgccaaggtgggatgaggttgatgatctggttgtgggtgggcaggccaggtggtaaaggccattgctaacatctgcccttgtcccccaggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccgggtaaatgaaggccaggggccccagaactctcctcttttgcacattttattccttatttctgactgcttctctgccaggtaaagctccaattgcccccacacaagccctggacttgttggggtcgaggtggaagtcttgggaggactgaggctttgaactaaacctgttctgtttcctccacagatggcaacccacacattgatcacggggctagaagagtatgtgcgggagagttttgtgagtaacccttctctattcctttcctctcctgggtctggtcaaggcagctgcctcctccactcccagtcttatgattcttgattttgggatctttgtgttatcttgtctctcagtccttggtgcaggttcagccaggtgtggacatcatccggacaaacctggaatttctccaagagcagtttaatagcattgctgcgcatgtgctgcattgcacaggtcaggggctggccaggcgggggcaagtggggcctgttgcatgtgcagggctgccacgtgccagcattccctccttgtattttgcccacagatagtggatttggggcccggttgctggagttgtgtaaccaaggcctgtttgaatgcctggccctaaacctgcactgcttggggggacagcagatggagcttgctgctgttatcaatggccgaattgtaagcaccacctagccccagatccttagccttttgtttcctgaggtttccattctctgcagttttcatttttcttttctaaactgacattctgtaacctggatctaatctatttctaaaggtggttgagggttttgtgttctaaatctgctttctgtccctcagcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccaggtaagggacctgttgggcgatggggtcagggtacttgagagaactggagagatctgagaggaagtatggtgttctttaatttcacagccacttcctgaggagccaatggaagttcagggagcagaaagagcttcccctgagcctcaggtactctagagagggggaggttgaggggccagataatgtggagtggagggctgggggagaaaggtttggaggctaaaaattctgaagcctggctcttcccgccatctgacacccagcggg

SEQ ID NO: 499 - DNA, 7376 bp, Homo sapiens
agccgagattgcgccactgcactccagcctgggtgacaagagcaaaactctgtctcaaaaggaaaaaaaaaagaaacctgtaaaatgtaagccatgctgcttcataaaaaatgccattttataggcaaatgtcaaagtggtgcctgagaccactggttctctaagtcttgttctgattcacttgaaggtccctctgaagtgtctgtttctgtccctcccccacctcattctgattcaggagacccatggaaggcctctttcctgtcagggagcctagatcagacccctctccagggacctttccacagaccagggtgcctcttcacccacattccagcaatgcctttttccctggaattccagctggggccgacccctgttctctaggcctccatgtccccactcatactcagtgctgcttgccatctcccattccagacacagacacacgcacacactttaacacacatgcacacacacacagccctcccggggccctgtggctgggtgccaaggatgtgaccagagctgatgcccttctcggctcccccaggaactcaccaaggcccatgagctggaggtgaggctgcacactttcagcatgtttgggatgccccggctgccccctgaggaccggcggcactgggagataggagagggtggcgacagtggcctgaccatcgagaagtcctggagggagctggtgcctgggcacaaggtgagcctgaaactcacaaggtgagtctgtccccacggcgtgaatgcacacacagattctgctctagaggagggaaaggccttgggaagtggggtcatgtggaaaaaacatctggaaacgcgttgatctgggttcagatcccagctctgccacttactagtcagaccttggtcaagacagtaaagttctctgggcctcagttgccacatatgtaaagtggggataataccacctacacatcagagcactggtttgaggattaaaaggtcatggtcatgcacaaagtgcctagaacctatgaagtggatccggtcgcacttaacagctggtacttgccattctaattatcattccccaactgaaccagcattctccccaccccaggagatgagccaggagctctgccaccaacaggaggccctgtgggagctcctgaccaccgagctgatctacgtgagaaagctcaagatcatgactgatgtgagcccccctcagccccagccccggccccatcttccctgcatgagcccccatcctcccagactggaaggcaggtcactgggggagggaggggcaggatttcaggccagtctgggatgcagggagataggtcagcagtactgaagttggtggggggtgggaggtgacgacactgaagggctgcgctgggtcctgagaccctcgtctccctccctgcagctgctagccgccggcctgctgaacctgcagcgagtgggactgctgatggaagtgagtgggtgctcaggaggggaccctggcacagcccgacctctgagcctggggatgagggtgggccctccagccatccctgtctgaattcccactgccccgttttttgggatgccttgccctccctacttccctgttactggggactccaagcaggccacaggccccccatttctcagactgacatccttgagatcttccaggcccagtgcccagttcatccttcttcacccccgcccctgctgtccaagcttaaggtcctcacctttcctcagccagtgccacccctggggaccttccaaaagtgtgctgctcagctctgctccctcctccaggtgtcagctgagaccctgtttggaaatgtccccagcctgattcgaacccaccggagcttttgggatgaggtgctggggcccaccctggaggagactcgggcctcgggccagcctctggaccccattggtctgcaaagtggcttcctgacggtgaggcctgtgaagggctgtgtctggatggggcaggactcggagccctcgggggtcctgtgtgtagggcatgcccacagtatgcaaatctctgtgatttgaggggccgcaggacacagcccctacccctaatatcacctcacctcctcccttcatgccacaagtctgacctctgtgccacaggctccttgttcttctggaggcctttatgaaatgaaaatgcagctgtctcagagaagggtcacaccttggctcccatcaactacaaaagctgggtgcagcaaatgaggcctaagtgaggggacccttaggaggacctgggtgggtgtaaaaggccacaggaggcacccggggcacggagaagagtgacaagagaaagcaagagggcctaggatccgactttcttctacaatgttacctagccaggaaaatgtgggccctgcaggaaaaagttgcagtggggtagagaggtaggcgtactgcccctgggagccttaggtaccccctccataggagcaaggcttctgagccaactcttaggtcgccaccccacccccagggtgaaatgggatctgcaatgtcctgacaacggtccagctgaattatcgatggtgggagagtaagtccagagcagcaggccccagtagcactgtggatagagggagctcagagagctctgggtcagtgtcgggacctcaggctccttcgtggaatccagagaaaggggcgtagcctcgagagcattcctgggaggatcctgggagggagggactgtcaggagctgggctaagggcccctgcgaggctctcttcacctgctcctgggtcctgcagctagagcctgtattcatggccttctccccatgcctgctccccacctcccgtatctgtctctccagtttggccagcggttccacccctatgtccagtactgcctccgagtgaagcagaccatggcttacgcccgagaacagcaagaaactaaccctctcttccatgccttcgtgcaggtgggagaaggggtgctggggagggggacgggtgcatcttagccggccggtctccagctgagcctgaggctgagttcaccactaggcagggcaggagggagcaaaccctgagccccacccaccttccctgcagtggtgtgagaagcacaagcgctctgggaggcagatgctctgtgacttgcttatcaagccccaccagcgcatcaccaagtacccactgctgctccatgctgtgctcaagaggagccccgaggcacgagcccaagaggccctgaatgccatggtaggtgccccagtggggctgggactctggtgaatcggggactgggaggggggtctctttcttagtgtgtctgtgacagtgtggcgctgtgctgtggctggcattggttgggaggggacggctgagccgtccctcctcccacacccccaaccccacctagattgaagccgtggagtcattcctgcgacacatcaatgggcaggtccgccagggcgaagagcaagagagcttggcggctgcagcacaacgcatcgggccctacgaggtgctggagccacccagtgatgaggtggagaaggtgagagggcaaagggaagggacccaggaaaagcaaggtcccagggatactggtgaaggggagggctgcaaggccagaacaccccgtacttgggtgctacaagggtgtccatcattcctacctggtggtgacagtccaaggggtacaggtcagaagagcaaaaaggaggccctgggaggctttctctagcccatgggggaaggatacaaacagaaaggtgttggtggcagaaccaggagccgcccttggccaggaagtccaggcagactgccgagcgccctgacccctcccctctgtgtccctcagaacctgcgcccattctccaccctggacctgacgtcccccatgctgggggttgcatctgagcacaccagacagctgctgctggaggggcctgtgcgagtgaaggagggacgagaagggaaggtgagggtgctgcggacagagtggaggggatggggcacggtgggagaaggtaagaggcagaaacgccggaagtgggagaagaggggtttggggaagaggatgtggttctggctaagccccagtcatttgtgtgaccctgagccagccactttgcctgcctgtaaagtgagagatgtgaccaaagcgacgcccctggccactcccgcatttgggctctgcgtgtgtccctgtgtgcctgcgcaccatgcctgagcctcctcccggaccagccctgcccctggctccagctgaccctgtctctttcccctacgcccccacccccagctggacgtgtacctgttcctcttctctgatgtgctccttgtgaccaagccccagcgcaaggcggacaaagccaaggtcatccgaccccctctcatgctggagaagctcgtgtgccaacccctgcgagaccccagtacgtccttccttcagggagtcttttcttctccctcttctcagcgaggggaaggaggagctgggacggagatcaaataaaggctggcctcttgaaggttgtctcctccatccagacagcttcctgctgatccacctcactgaattccagtgtgtctccagcgccctccttgtgcactgtcccagtcctacagaccgtgcccagtggctggagaagacccagcaggcccaggtatgggaaagccagcaacggggaggcatgggcaggggtccccggagctcagaaatgggagcacagtggtggatcacacctgtaatctcagcactttgggaggctgaggcaggtggatcacctgaggtcaggagtttgagaccagcctggccaacatggtgaaaccccgtctctactaaaaatacaaaaattagccgggcgtggtggtgtgtgcctgtagtccccattacttgggaggctgaggcaggagaatcacttgagcccgggaagtggaggttgcagtgacctgagatcgtgccactgcactctagcctgggtgacagagtgagaccctgaagaagaaggaaaaaaaaaagaatgtaggaaggaaggaaggaacgaatgaacatgggagcgcagaggggaggaggagagaggctggggtggattcagtttcagactggacaatctgatgtgccccagagagggaggcagagcctccaccatccatcagaagacagaaaaagcctttggccagctactgtgccagccactgggagagcccaagatacagcatcccctgaaggtttgtacagcctgaaatgattaacttctagaagtcatcttccattcgcagacatttacagggcacttgctgagtacggcaggcactagagctaggtgctagggaatcagaaaagagtaaaccaccattcctgccctcaaggcctaggtgctgcagcctggttgagtaattagtatacaaacaatagagagaagttatgtagaatgaagctgggacagagaagggagcaaggcattgtctgctgggtctgtttggaagggacacagaggagctgatgtctgagcaccatttgggaggatacctaggagtatgtcagggagtcagggtggaagggaagggcattccacatggaggagcagaacgtgcaaaggcgggaactgtgaaacagttgtgtgtgttgagagaactgcccccattggtattgctacagtatcaagtacaagagtagacgcagcagggagaggctagggggtaggtgccaccaggtcatgcccatctctgcatgtcatgataaagcatcctatagatgagctttgtcctttggatgacagagggccagtgaaggagtcgggcaggggagtgatgtgagcagataaaaagcaggaggagttcaaaagaagagagatgcaaatggagctgtattaggtcccacaaacttggtggcctaaaatgcatcagaagcttactctctcacagttctggaggccagaagtttcaaatcaaggtgttggcagagctgagtttcctctggaggctctagaggagaatccatccttgcctcttccagctcctggttgccccaggcgttccgtggcttgtggtaacaaaattccaaactctttctctgtcttcccatggccttcctctctgtatgtctctgtgtccaaatttccccctcctttctcttacaaagatgtgagtattagatttcgagcccaccctaaatccagggagaactcatcttgagctcttaggatctctgcaaatctgcgaagactctttttcgaaatcaggtcacattcacaggttccagagggtaggacttagatatatctatcttttgggggggccactattcaacccaccacaggaacggaatggccaaagagaagtgaagatttgagttagacttttaaggataggaagaccatgagcagcagaatcagaggaccagctgggctggatatatttctggaatgacggccatatctgcctaagtatggagcacagtgtttgtgtgagtgcgtggtaagaggccagattctgcagaatctcagagctgcagaaccctgtggcctggatgcgcttgagttaaatagggtcaacaagagacagccaccgtgaattctttttttttttcttttgagacagagtcttactccatcacccaggctagagtgcagtggcatgatcacagctcactgccgcctcaacttcctgggctcaagtgagtctcccagcttagcctcccaagtagctgggactgcaggtgtgtaccaccacacctggctaattttttgcatctttttgtggagacagggtctttccatgttgtccaggctggtcttgaactcctgagcttaagcaatctgcatatctcggcctcccaaagtgctgagattacaggcgtgagccaccgtgcatagccctgccatgaattcttgagcaagggtgaaatcagtgtgtttcctcttgaattaggttttcaggaaatcaggtagcagtgtgctgggtgggctggaggagggagaaattggtgacaggaggtttattgtactagtttgggtgtgaaacatggaaggtttagtgccacagccttagggagacattgcaaaaagggacaaaaaacaaaggagaagaaaggacctaaagaagagggaagaggccgggcgcggtggctcacgcctgtaatcccagcactttgggaggccgaggcgggccgatcacgaggtcaggagattgagaccacggtgaaaccccatctctactaaaaaagacaaaaaattagccgggcgcggtggcgggcacctgtagtcccagctactcgggaggctgaggcaggagaatggcgtgaacccgggaggcggagcttgcagtgagccgagatcgcgccactgcactccagcctgggcgacagagcgagactctgtctta

SEQ ID NO: 500 - DNA, 14938 bp, Homo sapiens
gttctatccttcattattgcttctttgcagttatttctcgttcttcctcatgataggccatgttattcgaagactgcttctccttttactagcctccttgatggctgtattttttcattgctttcatccctttgtccttttcctgtggattctatgagagcaattcgaatttgctctactgactggaatgtgtttctagggcttcagttctttcctttatggccactgtggagcgctgggctctgctgttgcaggtgggcacctttgaagcttttcctcctgtctggggtgcttttcacttgggcttgtgcctcagcctctgcattatctgagctcctctaataatcttatatccccattgctcactgagaatttgaaatatggatctttaaattcttttttatttcttcctaaaaatatttttttcaaacactgtattttcaactatagtcagtgtattcggttcagaagatgttcattggttccattggtccgtgctccataaaaaccttgttacagagacacacagcacactttcaccctcttgccaccctgggtcccctggctgaacaccccttgaagagctaaagctggaaggcacagtgggttcacccccagtcccgatgtcagtgctttggagacaggcactcattgggtgtggttggctgggctgaggaaggcaggttctctgacccacttagggtcaatgtatgcccttgtgaatacaggaaggggcttattttgttccaccaaataggctacacggaagaaaaagccatgccagtcctccctccgcccggccagcagcattgtaccttcggggaccacatggttcaggactcagtgggacatgtcctcccccttacctccccaacattgcaaaccagcagggaggaggagaggcaaggcccaggctcaggacagatgagcagcagtccctgccccaggggagggtaaggtgctctcagggctctgccaggttcagtgatggccactgggccaccaggccccttctcacctacatgcctctggccaactgagccactaacaatgaaaatgtcctcaaatgtgcccgagagtgtctcattatttttgaagataatggaaatccctcccaaggctaacaattgttgacactgttcctgtgcagtttttgtgttgctttttggctgttttctgtactttgatgtgtattttaagaacaagttggaagagagattactcagggctacaatagcctcaggtcaccgctagtgtccttctccttgaatccccataacatggagcccagaagctggcactaacagattctcagtaagaatagacaaatgagtcgtgagttttggctgagatatttgggactggaaactgatctagacccaggctgggatggatctagggcagggattgggctgtaacaggtcacagggagtgggggacgtcagaagcctctgaaggcacagacaccacctgaaccgaggcaagaggcaagtcccgcgtgcaaaccaggctgcccaggaagtacagggctggacggcaggacctcagttgtccggagcaggagccccacccctgtggagctgatgcgagccaccacgcatcagggggttcagggatagtgcaggtaaaggtggagctgagtgtctccagctgctgcctgggcctcggggcacaggagagacccagacgctgtggccacgcctccagggcccctgggcaacatctccacctgtgaacctccagccttcgcatgctgtccttggcctgcagggatcccagacccccactgacaacaagccttgcttctgcgaggcctgttgctgccacggctggtcctagttctaggcatgagattttgccctaaacacctttctcttccacctctggacactcacagtgggatgggggaactggaggacctccctgcgcccggtgtcttcataaagcagagcttcttgggcccaggcccctcggtcagccgcccccagccgcgcctgctgagcgagcaccagcaccaggagtccgggcgtgcgtgggagtcgccgtgaccaggcgagccagcatggccaaggaccctaccgtcctcctattgcagagcgtagtgacgcgaggccagagctgggctagaataagtgcccgggtcattaggggaaacaaggaaggaaagaggaggaagggcgagaaggcgagcccacccagctcagaagcgcctaccggcaagcccacgccagcctcctggcctcgcgctgcccaccaccctccttcttccctagaaagtgagtccttgacagaaaaaactgccaccgttctatgcctggaaggcgctagcaaatatgccacgggccgcaggcagccagctctcaggatcctggccttgggccacgcccggtgcgactgtcaccttgtccatcagagctggggtctctcaaaactgcctgcctgcgtcctgccacagtcagggccgagggtgtccgcatgggcttccaggaaagaattctctcctggggaatttcccactgtagctagttgttctccagcacattacacaggcattaaagggaggttaaatagccggtctaccgcagcagagaccctgggagttctgaaagccgccggctccatgccccgcctctgtacaggggaggctgaagcctctgcggaaggcggggatatgggcaggtggcagcgccggtggcagcgtgggggggcagctcggggaatgcacctgtacccagccacctgtgtagtgcctcctgcccctctgaactgcccccgcgggctggccacaggcgtctccatgagttcaacactaacaccgcctgccatgcaccctgttgaagaagccccagacagagggcaccggtagggacagaaagaaaacacctcttatcttgcttttgtaaaacgtgggccaggcacggtggctcacgcctgtaatcccagcactttgggaggccgaggcaggtggattacctgaggtcaggagttcaagaccagcctgcccaacatggtgaaaccctgtctccactaaaaaatacaaaaatttgccaggcacggtggcgcatacctgtaatcccagctacttgggagaggcaggagaatcgcttgaaccctggaagcggagattacagtgagctgagatcgtgccactgcactccagcctgggcgacagagtgagagtccatctcgaaaaaaacaaaaaattgtggaactgtcgcacctatcaaaacaatttttgttgtggagtttattgggggggggggggtgggggatgggggagaagcaagaattataaatagaatacagaaaaaaatgtttattagtagagacaaaaagcattagataatgtccctcatgttaacatctctaacaatatttaagttaacgttaggtgagtggccaagatgagcatacgctggggcgtaatcccaggaatgcaggctgggatggatctagggcaggggttgggctgtaacaggtcacaaaggaggaggggttgtcaaaagcctttgaaggcacagacaccacctgaaccgatgcaagaggcaagtccagcatgcaaaccaggctgcccaggaagaacaagggctggacggcagggcctcagctgtggagggcaggcgccccactcctgtggagctgatgcggagccactgcgcatcaaggggttcagggatagtgcaggtaaaggtggagctgagtgtgggggtgtgtgctcccaagccctgccctccttgctgccttccagcctctgtacccccaaggtactctataccatggttctttctctattccactaacacaaaggtcagcctgcatccctgcctgctccaggtattttaatgacaacctccaaatattggcttcttctcctccggcccccctgcatctggtcctgcccattttcccctcctctcctatgggccccttcagtcccagcccctggccgggacccactggggcacacattctgccctgtgcttctgttcaccaccgtgggctgcccttctctttccatgggcttctgtcaaaatcccacccagccttcaagggctgcttcagttctgtcatctccagggagcctgagtctcagccaggactgtcctccaaagctccacactccccctcgtaggtattcacacactcaccgagcctccctttgagacccgagccccttgggggtagtgggggtctcctcctctctgtgcccctcagcgcctcacacccttcccaacactaggacattcagtagtttggaggacgactgaaagtgcgggtgatatgtggctctgcgactgtgtggtttgccccccactaatttgtcacagttcaaggaacatgcctgagcgttttcatgataatgagagaaaagacatgaaggaggagaatggaaatagaggctttggagaagttaagagtattgaagttgtactcactgtggctccccggagtcctggaaatcttgaggggacagtttagtggaagacttgatgatgagctccttctcctaagagtagcacagtggaccaaaatcttgtgaagcaaacccctcccacgtggctgtgagctttatagatgtagttaggcagaacaatgtgttactcaaaattcctctctacttattcagagacaacttgttctgaggcccatgaagggtaaaacttgagtgtcttgggggctctgagggagggaggaacgttcctgccgggacacaaaggtggctgagctgagctgggtgtaaggagaaggggcaggagagagggggcaggcatcccaccctccatagaaggacacagaactgcaggggcctgctgtatgtagacttcaggaaactagtgttgagggggcttcagcaggcagagatgcagacagcagcagggactcaccgacctggtaggggcctcatcgcagccaaaagagctcaggtttgggcaaattacatcaatgttctccattggtagtgagagtctctgctttcattcatgtacacacaaacacacacactcacacacaggcttagctagcatgcaaaccaagcggattctccaagtgtttatctggatcaagttgacttgagtttaaatggcaagccgtagtttggagcagggtgctggccctggtggcccacagagggcctgaatctcagtggatcctgatcctcccctaggtgccccctctccctcccctatgtacatctatacatagagagggctccacgcctgttcaattggaccccgtgagtccatctggaggatgattaaaaggggtggaaggatgatatactaagtaatgtagaaaatggagtcttgtttactttaaagatggagaagacagtttgccaataaaacatagcactccatttcctctagaattctgttattaatattaatctgcaatgaactcctggcacctctctcacaaggccttccaaaggctttaaaaataataaggcatgctccagaagagcagagtgcattccagcaagatagctggaccaaattgccttctgctgggtggggggagtgggaaggcaggcagctggcagcttcacaaattaagcacattaaggacacaattagtaaaggaatgtcatccctccatctcttcagagacacccacaaacacagtctaaacacatacatgaattcagctcacaactttactcttatacacacgggctccaaagagacacacacaaacgcagaaccacaaacacacacgcagagacttgggtacaatcttgacatggcacacatgcaaaatacacgtttgcacacacagacacaacatatgcacagacattaggaagaaaatacgcagtgcactcccattgcttaagtgtcaatgtcagatgctgggcccctgcaggtttctgaaagtggcctgggggaagagggagtcagagtcccacagagaccctcctgggcagagcgcatcttttacgtaatcctctggcatgaaatggtgaaacgctgatacccccagacctcttgagccccgcagatgatgaggctttgtggccccctctccctccacacccagttctgaagaatgcttggcgtcaagcgatgcagagaccatcccagagtccccctgggtcctttccctggaaagcatccagaggaagtctgtggtggcccaaccctgcccaggctgagaatgagatgatatttggcaacctccactatccccttgttttaaagtcaataattttgcaaaacttttcatttaaatcattgaacagcgtaactttgagaaatgaaatacattttgtaggatgtaggcattatcgcgtgcaattgctgtccttctctgcccacatccctactctcttctcagcaagaagaggagcctggggcacctgtggccactttaagcaaggctaagtcaggacagagaggagccaagacatgggcaggaggagggcgagaagaggccgtgactttggtgcagtccttgagggcagctagtgtgagtcaagtgttgattaatacagataaggtcaagtctagaaggccaactctattaaactcaaatcttattatcacatcttacatggacattaaaacctctcagataatggcagctatgtgcactgagggtgacatcgtggtttttcaggcactggagaaattactttgacagggaaacttacgtgctgaaggcaaaacagcagataagcgagctgggccatttcctgagagtcatgagacaggatacaatgtggctgtcatgctaagtgacattcagtcccttcagaggtcggcctggtcatgcctgcgagacgtggccccagcagcagggtcacccttgggccacagagcctgcagagatggccagggctgcacatctgaggggacaccggcaggcgaggcagagcccacatggcctagtggtgtattggtttatgcaaaaacatttctcggttttttggatacctaatacattctaaaagatacttttttaaactaaataacaatggaagaataaaattgtggactgtgtgcaccccataatgcagaatgagcacgaaggtttctgtacatctttattcctagatgcttaaatgtcaaataaatcacaacaaaatattctctccgcttaatgccatattattaattcaatagtttctttttctcaactcagctatcagtaaactttcaggaagcctcctctatattatacacggaaagcacaagggtaaatggtatttgtttcctctgggaaatatttgctgattgtagaaaattgtgtgagatccttcccacttatggagaataccttcatgaggcagaatagatttcctcaaaacttcaagagtgagcctagagaatcaatgcatgcacacatgtacacacatgagcacacacacacacgtgcagtggtgggcagtggatggcccccaaggtccccgtccctgctatagaatcccctccccagggctgtgaggtatgggctattctcccccagtgaccgctccctctacagcaacagggattctgcagaggtaattgaggtctcttgtcagttgactttcagttaaccaaaaaggagattctcgcagttgtgagcctgacgtgatcaggtgagcccttacaagggcccttctggagggagagactggaagtgagaaagggccgtgccagcagccccgacacaaggagctaggggtgaccactaacaaggagctaggggtgaccactaggagctaacaaccacccccaggtgacacccagcatgagaatgggcgtccctatcctacaattcaaggaactgaatcctgccaacagtcacgtgagtctaaagaaacagcccaggcaacgccttgatttcagcttcctgagaccctacgtggagaggctagccacgtcgggcctgaacttctgtcctaaagaaactgcaagacaataagtagctgttggttccccgttgtgtggtaatttgttatgcagcaataaaaatccacgtgctcacaccagcacccttcccatagccacctgcttctgagtccattccataaacaattccaataatcaagaccatggcattcagtaactcctgcattttatccctacgtctacttcccaaatgtcctgcaatgtgcacacacattcactcacacacacactcacacatgcactcacatgcaaatacatacacattcacacactcacatgtgcactcacatacaaatacacacacatgcactcacatgcaaatacattcacacacatgcactcacaaatacacccacacatgcactcatatgcaaatacacacacattcacacacatgcactcacatacaaatacacacacatgctttcacaatcaaatacacatacattctctcacacatgcactcacaaatacacacattcactcacatacacacatatacacattcactcaccttctcacatacaaatacacattcactcacacatgcactcacaaatacacacacattgacacacacacatgcactcacaaatacattcacgctcacacgtactcacacatgcgctcaaatacacattcactcccacactcactggcacactcgcacattcattcagtcacacatacacacacttgcatacacgcactcagtcatacacacttgcatacacgcactcagtcatacacacattcaaacataaacacatattcacactcatacacacattcactcacactcatacacatacacagtcacacacatgcactcacacacagggactcacatacacatactcaaatacacatggactcacacacgtgcagtcacacattcacacacacattcacacacaggtgcacacacacaggcactcaccttcacactcacacaggcacactccagggccgtcttgcaaaggaagcaagttctggggaggatggaagatgggagggttacatgtgagggacggagtacagaaggttcttaaaggcaggagtgggaacgggagcctggtgggtgcccagaaggtggcagccgggttccgctggagtctgagctctttaacagggaaggtcggggcctggagctggcgaggggcacccacagtgtggatgtggcggagagctctgccggccatgaggaaaggggatggcccgagcaggcaccatcacccaggtcagggcttggcatggatggcggcggggggctcccaagcagacctgctgcgcaaggggctcctgccagcagagcaaaagcaagggcagcacggccctgccgagggacagaagcgactgccggagcagaaaccgggaaaaaaagggccccttgtcccacaagaagtcagttgagagagaaaaagagcaggcccttatcccaccagggtaagtgcccccggcagaaaacaaaacaaaacaaaatgagaggatgcattctcccctggtgccttcacgttctcagctaaagacctgtggcgcccacagtaaggctgaggacgccatggaggcaaaatgccatgcaactgtggggcctgcatgcggctccaggaaaccaaaacccactggggctcagctcctctgggaagcagccaagcaggtgccctgccctagcaggaccatgcctactactccccacacagcctttgcccacctccccctcgcccacccggacctgcacccctgggagcttgtcacacgtgttcactgccctgccaagcccctggggatgcccttgtgtttggccgtaactaagtcctcatgttgtgatccaatcatttccctcagggagtaagggagttcaagaagaccatggacagggtgtttattacacaacttcttcacagtaattctcctgccagtactttctcactgtttaaaatcaataaggaagaggtactgtattagtccgttttcacgctgctgataaactcatacccgagactgggcagtttacaaaagaaagagttttaattggacttacagttccacgtggcaagggaagcctcacaatcatggcagaaggcaaggtggagcaagtcacgtcttccgtggatggcagcaggcaaagagggagaaattgggcaaggaaattcccccttacaatactgtaagatctcatgagacttattcactatcaagagaacagcatgggaaagacctgccctcgtaattcaattgcctcccaccaggtccctcttacaacacgtcggaattcaagatgagatttgggtggggaaatagccgaactatatcaggtaccaagggtaaaacccagggagcagctgaggggccaccaggggcgagaatgagaggagaggtgaagggcaagtccaggaccccaggagcgtgggtcccaggcagaggcagccctgaatgcagggagcagaccctcccctcctccagcccctctgtttgccaccaaagggctgactctctgggaaccaatcttacggtgaccactgagcgggcaggaagcttcctgcaagttgaaagcatgaaggagagaagaagaggtctcaggagcacaagccaagtggggctggcacaggcgagcaggcagagaggaagcacacagcaggggatacagtgaagggggcctggggtcatggcaggcgattcatgtggccagggtcccacctccctgtcagagtgcagggcaaccaactggtctctgggtcaggatgctgcctcaccactcaccgttgcacacccctgccagacagaggcctgtagctacctggattttcccccagcagaaagaatgtggacttcagtgagtgaaagtcttcatcactggtggtccaagatgctgatcaaaacagagcttcctcctcagccttgaccaatgacagatgttctgataacattactgtgtatggcactatcacagaccaaaatttatagggatgttttcttgaatctaatttttattttactacgtattttttgaaataaatgcatattttcctagacactgagtcaattccataaacacctgtgggtgccagcaggcgtgctaggagcagaggccattggagacatgaaggctcctgctgctgggagactcaactggccataacccaagtgctatgtgttgggtgaggaaggcttcacccaggaagggacgttgagcacggataggggaggagaggaccaggtgggatttgctgggcagacaaaagaaaggcagtgcagaaaggaaataactccttcaaaggccaagatcttgatgaattaaactaaggaagtaccaatataaataaagaaaggggggaatatgagacccattaaaggagagtgaattccaaaggccttccataacgggggttaaggagctgaggcattcaccatgaccccctgtgagggagcggaaggtggtatcaccagtggagacttggaagaggccggaggagcaggctgcaggaaggaagtgagttcagtcttgactgtgtctgctggacattccaaagctgctgtctgctaggcagtgaggagttaggcaggttcatctggagaccaaggagcagggttggtggtaaaaataatgataataataattaattaataaaaaaaaaaccctggagtgtgagttactcagaaagagcatctgttaaattagcagagagcagagccatgtggagcacacatttcctacagagtttgtagggtaaaaatacataagaggtgggtgcagagagagaagatgtggttgcagagactgatgaagaacagacattgcaagtaagagcaagggacatgcggacccacaagcattatcactgtgagctggggatcaaagcactttctgggtgccacgtgcttcatcggcaaggcctcttcagtcttcccaaagtttctgtgtagttacttgctctcttccccattttatagatgagaaaaagaagtctcagagctggtaagttatgagtccaaaatcacacagctcttacctggtgcagctgccgttggaacttaccacaaaaaaaaacatgctctttccactctgctgggcagcaccaggtttgtcacagaagaatgggaaggtcacaccttcagattctagaaagagaacgggtgagaggcgtgactgtcacctgcctacaggagagcagttttggtggagtttgagaagtcgcagccagattgcagagactaacggaggggctggacggggagcgacataggccagtttctcttgccagaaagaagctcaaccatggcatgagacaggcctcactcgggctttgcagtgagggcatttttgttttctcttttttgttgctgttggtgttttaagcttgtgcatgttcataatctgtgggggaaagagtcaaagaaggaaacattgaggactcgggaaagcaagaagttaaatacaggaaagaacaaagtacccaagaggaaaaaggtgaaggtgtcaagatggagaaggagaaattatccctggatgagaggacagcgcctttgattcagagacctgagaacagcagggaagggcatttgtcggcttggggccaggaagctgaaggaatcttcttctaacctagggaaagatgtgcatgccagcaggggctgagatggggcagtggggagagggaatggaggagcatggtaacagtggaatggccgttccctgaggaaggagagcatacccacccgagccccatgtgcagcacagcaggagacctcacaccagtccttgaccaatcgcataactctcctatcttcttggccagccatcagttgcaggtaagcaggaggggagagcagatggctctacgggttcacagttgggcactggcagaaagtcaaggggagagggactggcaggggctggagtgaccttcagaagacatttacgagaagaaaggcatgttgcaatatgtgttgtaatgggaattggcaagacctttataccaccaagcatctaaggatgcagttttgaatcatgtcgagacagctctacttggagctttgtttaaaggcttcctaatcttctcccccacccgcctctctttcaacacatagtagataaatgctaaatagacaaatgtcccagttagcctcagtaacagaggaagcctcagtaacagaggaaacccaagctgtagggtttcctacatttttccatggaggaaaaatgtgaaatgtccacacgcacaggtggtgctctgtccctggccgcactgcatgtggcctgggtccctgatgccattcctctccaggaatggcaagcacgtcctttggggctctgcatcctcagagctgtcttcttccacatgcttctccttgcagcagtctttgttcccttatctgtaaaacagggcccaggacttcaggggctgcagccctttaaaattctagcagttcgtgagccctcctcctccttcagcagctgctctgtagccattacttctgcatcctcctaagacactatagaaagggtgcacccagccccagaatgctgggtgactcagcccttcctagcttccagatggatggcaagcccagggctgccagcaggggcatgggctggggacagaaaacaagaatgaaaaagaacagtgccttttggccatcttcccagagtcttgcacctcgtcaccacagtcttattaaccatttggtccaaaatattaccttaaaaaatgtgttgaaagtaagccactttttaaaaatcatgcaactgtcactatggaaaacagtatggcgttcctcaaaatattcaacacaggattaccatctgatccagcaactcaactccatttctaggcatatatacaaaagaactgaaagcaggatttcaaacagatatttgtacgcccgtgttcatggtagcattgttcacaacagctaagaggtagaaccaaacccagtgtccatcgatggatgaacagataagcaaattgtggtatagacatgcaatggaatattattcagccttaaaaaggagggtcattctgacacttgctactacatggatgaaccttgaggtcattatgctacctgaaataagccagtcacaaaggacagatgctgtttcattagacttatatgagatacctagagtagtccaattcctagagacaaagtagaatggtggttgccagggcctgggggaagggggaaatgtggaattgttgttcaatagatacaaagtttcagactttcaagatgaaaagacttctgtaaatggatggtggtgacgattgcacaccaatgttcgatgaacttaatgtcactgaatagtacattaaaatagtacttaaaaatggttaacatggtacatttcatgttatgtgtattttaccaagataaaaaaaaatattttaatcatgcaaatgcttccttctccttccctactccaggatcagcagccacacttctgtcccaaggagtgaagctgagtagagagcgcaccctctgcctgggacctgatgaaagatccaagcagacagcggccccctgcggaaccgtggacaccgagctgcctcctgttccagcaacagcctggacccccgactctgggtgcagggtcctcaccggtgtcccgtgacagccgacacgcactgcgcagcccgagtcgactgctcccactccgcgctcccctcctggaccccgcgcagctctcctgcgcagcggccaggctaccttcccagtctccatcaaagacataaattatcgaaattctgccgctactcctgacagaagcgaacgtgaggggtctgtgggcctccgaccctggaaggagcgcgcggtgccagtgttggatgaggacgcagcgtcgagcaggagaacgcagcacggaggagggcgcggccggcagcagggcgcagcaggcaggctgtgctgggtcccctgacgctctcccctgcttgttccacggccgccccgcagcgccctctgccggcccagcccagagcgccgctccccgacacagcgcgcgccggatgtgcgcgcccccaggacccagaagctct

SEQ ID NO: 501 - DNA, 42175 bp, Homo sapiens
acctccctagctcaagcgaccctcctacctcatccacctgagtaactgggaccataggcacataccaccatgcacagctaatttttcttttttacgttttgtagagatgaaggctcattatgatgccctggctgatctcactttttttctttaatattctgcaatttcataactaatatatgaagatgtggatttttcttctctctctctctttttagagacaagctcttgctctgtaacccaggctagagtgcagtgacataatcctaactcactgcggcctcaaactcctgggctcaagcaatcctcccacctcagcctccccaccagctgggactacaggtgtgtgccaccacacccagctaatttttttaattatttttttttaagagatggggcctcgctatgttgcccaggctagtcttaaaactcctggtctcaagagatcatcccacctcagcttccaaaagtgctgggactataaggcttgagccaccacccccagccctttctttctttctatctgcttgaaattcattgaaactcttggatctaaggattaggatctttcaacaattctggaatgttgtcagccattatttctttaaatgttgttccatctctgttctagcatctccttctaccattccaaatagttataaaacagtctcatttttcttccaagtcttttaccctcttttcatattttccacctccaagtatctctggattgtattctaaggaatacttcagatatgttctctaggtcactgactcttttcacttgtgtttaatcttctgtttaattgaaccattgagttttaatttcagtaatatatcttttatgtctagatattctatttggatctttttcaaatatacatgttcactgttcatattttcaatcttttagaatactatctaacaatattaaaatcagttatttctgcttgttctaatacacaaaggctttgtggctttctgctacctgttccttttgtgggttctcaccatggtgtctggtattctcgtttgctttgcaaattttgactgcagactactcatttgtcctgaagacttttctgtgggaatgtttggtggtttgtgtagcagctgagttcttcaagataagacttgtatttgccttggggcactgccaacctaaaactactttatacttaattttctatttcaggcttttggaagcacacaagtagtttgatttcagactacaaagccatgtaggggctgacttgtcctgagaaggtaaattcttagagatatgtgtttccttccagcaagggctggagttgagacagacaaggtttctgggtattcccttctgccgagtttatttatcttgatcacccttctattgtgaatgtagccctttgagagtccaggtttatgcagcagtttactgttagactctccatcttagacatatcctaagctttatctcctggtcctgattctttatgtaattcttcctctttgtctctaggatatagtagacaactttagaaaaaagccaagtttgctagcctcccattcatgccccctcaatgttgtttgaaaagatatttaaaaatacatcttgcagcattttggttgtttttatcaggagggctgttcatggtaactaacccattattatgctggaaacagcatatttcattaaataactttataatgagtaaatataaatgtaaacttatgaagcatatttatattaataagttaatgattttgtcttctgttatctattaggcttccatgcaatattcttttttcagaaaaggattctactctttacaaagttttgaaaacttcttccaaccattaagtgtaatgctttctccttataatgctactaaatcttctctagcttgactaccactgatggtatatgaactgagcctcagtctatcaccctccttacaaggtcaaataattcaggtggaatgggcctaatgacatattttcaaacttttaattttgttttcttaccagtaaaacctcttctacctagaaaactttctaggtaggggttttctgctctggatgcaggggctagggaggaagatctggaatgcaacggatttggattcctccacccctttcctgaagtacctcatgaactctgaaaatgttcgcttagggtttcagctatgaggccttgggcatttacttgatccctctgtacctcagtttcctcatatataaaagagggataataataatgctaccctaacaagattgctgtaataattgaataagttaaatatgtgaagcacttagtacagttcttggcacatagtaaacactatataagggctaattgtaaaaaatacaggagagctaggcatggtggctcatacctctaatccaagcactttgggtgaccaaggcaggaggatcacttgaggccaggagttcaaggttgcaatcagctgtgcacttcagtcctggttacagaccaagactctgtctcaaataaaaaacaaaaacaaaaaaaggagaatttttatttaactctacatgcttttgctaagtatttcatactcctttgaatttttacaagattcagaatttttacattacttgtccaattttatgtaaaatgcatttaaaaagtaaaagaagaaaatgatctcaactttagagttaaactaaaaccaaaggtctctatgttccatgttgtttttttttttccatacattgctttcttctagcagtgagaactttctgaatccattaaacaacagccaggcatggtggctcacacctgtaatcccagtgctctgggaagccaaggtggaaggatcacttgaggccaggagttcgagaccagcctgggcaacaaagcgagaccctgtctctacaaaaataaaaatttagccgagtgtggtggcacacacctgtattcctagctacttgaagactgaggcaggaagatcccttgaacctaggagttcagtgaggcaatgatcatgccactgccctccagcctaggtgacagagcaaaacactgactcaaaaaaaaaaaaaatcagctttcagatatttgggtactaaagaaaaaaacaagtaaaaacaaaaaaccaaaaaatgctgcagactctgtggacttttcttttcactgtaattttgtcctgctgtaaggttagtagaaaggagaagaggagatcacaaggctgaggcagaatttgtgtgttttctgaggatggtaccctttgtgtgaataaggggctagtgcagctgccagtatagaaggggccctgggagaaggaaataaatgagctaaatgaggaacctgtacaggagcacaggaaagagtcaaggaggaaaatgctggctttcacataccctccttgttttgaagacaaggaaactgagacctggagagctgtagggacttgagggaaaggagaaaatcctaggtctaagcttgggaaggggatgccaatctacctttgcttcttcaaagattactacagacttgatccactggggccctcaaagtatgtgaggcatgggagggggcccaggaggggaataaaacaacttgtactgaataatttgaaatgttcagtcacactaaaactgcagagccacaggccagctggaaagtcagcttttaaaaatgctttacaaagagcactgacccaagaacaagaagacgtgcgttctattagactgaggcatttaagactgtcatttctgtaagtcaaaatggtgaagtagtgccagcttcataacagctcaaccagggaatctacctccactgctctgcagatctttgggatttgggtagggtccccacatctgtctagtggatgatgcctgccttacttagtttatagggtttctgtaagcactgatccaaattacacaacatttactgagtgcctgctgtggataatttctggggaaataaagatgactaaagcacaacccttgttcccaaggacctagcagtggaggaggtaggaaaacaaacagagttggatctattattatatatataatagataaggaagggagagaggaaacaataaagtcggcttgattgtgggttgtcagggagatcaaaacatttgaattggcctccaatggttaaacagagtttcccagacaaagggatgaggtagcactagcaagaggaatagtttgagcaaagccatgaaggtgtgcaagtgcatggtgaattgaggaatggtaaacagtctaattggtctaaatgtagagagtatggagggaggggtaagtaaggttggaaaagttgatggggcaggtagtgccaatgtatagaaatgactggataagaccacatccaggaaaaccatggcaaagcacagaagtactttacaagtgataagtactgtttaccttaaagacataaaacaaagcttccctaaaatctcacactatccctccctcttctcacgagggctttggcttgagtcatagattgatctactaggtatctttatagagtatttcctttccctaggagaagtgttctccccagggtccaggaaagtggcagatggaaactttcagagtggtggagggtaggggacaggaagtgatccagattgggtgaggaaggtgctgtctcattattccccaaacttctatcttccctttttccatatcatgtattctaatctcccttaagaaagaagtgaaactgctacacccaagggagtagaggattggtgtgtcacactcccctgtgctcccatcccccgcttctcctccacttctgcccctttgcaaaatctcccagaatgaagtcatattgtgttggcaaacttagtcataatccccatttcctctccttatcagccaggacctgtcttcttccactgattccactggtattgcttccagtacccagcaatatgttcattcatcccactatatcctcatagatcctcttcccattcaagagaaaccaagcttgacaaggagatgaatcaaatataaggtcctgggattcaattatgccccattctaccaatgttctccatgaactaagagaaagagccagatagccctaatatcagattctggctttgctacttcttacctatgtgacgttttgcaagagccactatttcttcacttctaaaagggagacaatcatatccaaactccagaaacacagtgacattagagataatatacatagagcatcagtcttacagaagacgccaaacattgcagctactactatcatcattatcatcttcaccacaaccaccattattaagcatctgaattaatgcagactcctggctggtctcatcccttccctcttattgccctccatctgtttctcacatgatagtcacagcactagtttaaaaataaaaatcaaatcacatcccatgttactcaaaacccttctttggcttctcaatgcactctgaatgaaatccaagcttcttcctttggcctccagggcccagcccaaccaagcttctgtccccttctctctacagccccttcacattatgctctccccattgcccgctctgctccagccacactagcactctctgttcactgagcactgcggcttctgtccatctcagggcctttgcccctgaggttttctcttccctgtgtctcttccctttcatatgttcctcacgccctttgggtgcagtttaaatgtcaccttctctgactacactaccttagtaccattctactttatcttctttaccagtccaattcttttttatcactgttcattaataacatatttgtacaactatgtgaataacttctatctccccaatagaaagtaaactccaggagggcaagacagtttgctttgttcagtactgtatccccagcacctagcccagtactagaagtagtattttatttattaatgtttttaggcagcactccatgctgtagtacaagcaaatgcaaatccagcatcatttgtgccctcaggatctcgaggaggttaggatttccttacaatcattcccagttgtgtctcttttcagagaatttactctctaggacatcaaaggtcaaactttctcttttctgtattatctaaattttccacaatgagtatgcatttttagtaagaatttctcataaactcagcattgtaacaagactcatcacagcaaatcagtctgattaaatgaatttattttgaaagtaaaattcacaataaaagaagaaagtccaacagccaacttaacattcttaaaggtattagcatttaaaagtgggaaattgctaatcaaagagcattgtctgacatataagaggttagtgattcaataaatgattttccagctgatcagatgtagataatatgacaatgtgaaatgaaaacattcatgcagcaccccatgagttaatgatggtggaatacatagtccttggcatgcaaagggtgctcaatatttgttggatgtaagtttctggaagatttcttcagccaaagagaaaactacgcaaatttgcatctttgaaaatgaaaatacctcatatatttctcactgttgttgttgttcagaggtgaatgaccaactaataaatttctatttaaattattttatttaattattatttcttgacagattaaaatctttcaggttgtttccctaatttaaatgtatgtcatttcctctgggatgttccccacccacacacaagcatactccttactctctccctccttttccttcaaaagcactatttcctatgattatctaaaatgtgactttcccctggtgatgccatattcttaaaacccactccattttcttgtgtgcacatttcccagggctagtagagaaagcctttctaaccccatccccaaccctgggcccaactacttaaactaatctctttcctttctggtcactagggaccctgacctccttttctgttcactattgcctctgctgctgtcacccttggtgatttcattgctgttgtcacccttagtgactgctttgactctttaacactcctcagcagttcacccaaaaaatctcattctgaccaccatcatcatcagaacatctttctctctaagataaggaacactggaattcttctgtttatgaacaaactcccatctttctacttcctccactcccatttaaaaaattcctttttgaaccattttttaaaattgtggtaaaacatacataatataaaatttaccattttgaccatttttaagtgtacggttcagtggcattcacattgttgtacaaccataaccactctccatctccagaacatttttttcatcttccaaaactgaaactctatgctcactgaacaataacaccacattccaaagttaattcttttttatattctctaaggatctgtttcagatttttcccacttatacttaaaacttcaaaccaatgcttatttctcttaatctccgtctctttcagaacctacattacaaagattgaagccattttataagacccttaagttcacatccctagaccttaaaacttcacatcttctctcattctctcactagttcctcctctactgcaggaagaagtgtgcctcctccttttcaaagctgatccttccacttgtgttctttccccctctcttctgtatctcctctggaaatattatgtaagttttcctcttttcattggctactttctttctgcattgaagcatactcaagagtctatcacatcccaatataaacctcaatattaatgacaataataataacaaacatattgagtctctactgtgcaccagctactgtgctaagcgctgaaaatatatcttctcatttaattctcacaacaacctaatgagttaaattatgaaattattatgggtaatataacagttattatgaaaattttcattattattaagaaactgaggcttcagagacatcaagcaacttgtccaaggtcacctagctagtaagtagcatcttcccttctccacactactgtgtaaagataccattctttctttctttgttccctttcattactgtattatacttcttggaaatgtcttacttcctccttctccactctgcgcagtccagtgcagttgttttgagattcccaccatacttaaatgactcctccaatgtctcttaatcttcaaccaggtctctatagtactcattaccaactgttcctgctttttgagacagtgttctctcttagccttcataatatgaactcttcttttttctgcttctctgtctggtcttcttattaacttcgtttctcctctttccccttacatgttagatattccagagtttcatcttcttacagctttctcttcctgctccacactcagccaagacaatctcattcactcccacacaataaactatcatgccttcacaaatgaagagcaaatccacatggctaagtttggcctctggccacctagttccaactccctgctgaaatgtccatataactgttcctcaagtacctcaaactccatctgccctacatcaaactaattccctgtccctgtcactgaactccccacctgagtttcctattattaaccactggaattatgtccacttcccttcaccaccctgcttcccctcatccccagtccagagcaggtacacccacatccagaaagagccgaggaggcattgtggcagacgtgcccctaaactgggagtgagacttgggttttaatcctgactcagccacttggtaactgcatgacttagtggtacagaacaggaatctctggggcccttactcacaccaacctgcaaggactctatgaagtacctgtagcactcatcattccatcccctcctcgttagtcccattaacattgccctcactaggtcctcactgctttttgcctgggatattttaactggcctcctaactattcattctttttgcctccgtctccttctttccttccttcagatggtgcttcacacagacataaaattatattcacaaaacacactctagatgatgtttctcatttgctttagaaactttcaaaagattcgtgttgtccacaggataaaattcaaactccttattgtagcattcatagtcctctgcatactggtcccaacataacatgtgaaacttcactttgtctgaactgaatttcaaatgtagttgtggtatgtatttggaaggaaaaaaaaatcccaaatgtattcttttttcactatctttatttttttcatttttggtgacaagagtctcactctgtggtccagactggagtatagtgctatcagagcttactacaactttaaacttctgggctcaggtgatcctcccacctcagtctcccaagtagctaagactgcacgtgcacaccacccagtccagctaatttttaaaaattttttctgtagagacaggatctctttatgttgcctaggctggtcttgaactcctggcctcaagtggtcctcctgcttaggcctcccaatgcactgggattacaggcatgagacacacacccagccctgacttattctttataccaaaagtaacactgagtcaatcaaagatttatgtataaactattaaacattaaagttttagataatatcataagtaaatttatttataatcttggaagagaaaaggtattttgaagcagaacacaaaaccagaagttctcaaagaaaacactgattatattttaccacataatatttgaaaacttatgtatggccaaaaaatgccattagtgaaatctaaacataaatgacacaggggaaaaagttgtaacacaaatcacagacaagggtctaatttcttagtttaggtagagtccttaaaatcaataatttatagaaattaacaatacacattttttaaaagatgctcaatctcatgaaataaaggaataaaattcaaaactatcagatagtttacactctttagaaaggcaaacatttcaaaggtaatgacactcattgttgctagaaagatggagaaaagggtactcccctggattgttcacaaaactgttaattaatacaagtttttggaagtcaattcattaatatctgtcaagctataagatacatgtaccctctgatccagcaattccactactaggagtttatgctaccaataaacttataaatattttcaaagaatcacaacatacacccacacccacccacacccatacacacacacacacacacacacacacacacacacacacacaactgtcagttgcaacactggcaatattagaaaacaaaaacaaaaataaaatctggaaacagccagtgttaatcaataaaagactcgttaagatatatttctatgattgaatgctatttataatgttacttgtaaaagaatgtttctaatatgtgaaaatatttatgatatagtgttaattggaaaatgcaaaaaaaagcttaaaatatatttgcagtatgattctattttttaaataaaagagatgtgtataattttttacatagaaaaaagaatgtcaggatctaccacgcatacactttcctgtcatttacatattttctaagtgcacatgtatcttttttataatcagaaaaaaattactttaaatgttttcaactttctgtagaaaagagaaaggaaattaaacaatctgtgtccttctatattatatgttatgcaataaacactgcctagagcctatattgcaaagattttataaaagttaatgattaactaagtgtaactctttgacagtgctacaactaggccgggtgcagtggctcacgcctgtaatcccagcactttgggaggctgaggcaggaggatcacttgcggtcaggagttcaggaccagcctggccaacatggtgaaaccccatctctataaaaatacaaaaaaaattggccaggtgtggtggcatacaccttgtagtcccagctacttgggaggctgagacagaagaattgctttaatctgggaggtggaggctgcagtgagctgagatcgtgccactgcactccagcctgggcagcagagggagactctgtctcaaaaaataaataaataaataaaatgaaagtgctacagctaaaataatctctgtttaggatctgacggtaggaaaaagataagctcccacacgttctaatgcatttaagtagctccatctgcattgcctcatacatcaatactgtcatccaatgttgcttaatccatgtgtgtgtgtgtctatataagtagaactgggatgtaactgccttaaatactacaattgctgactacaggaaacctcatcatctgagaccagcactttataaattaggtgagtatcataaccagtgtgcagggatatctgctgtatatcattgggaatagcagcaaaaaagaacaagtgatgttcctattgccatatgttctgaaatatttctgatataaaaataggggagtaatgagtcaattttagtatgaaaaaaatggtgaaaagagtgatcaaggcaaagaatttgcaggttatttgaagaaaatactttttcagaataggatttgaaaatatttcctgactatgcttttgacttatcatgtggttctataaagggtgttgactttctctgtgtcaatgactccattgtaaatgtggtattttcagcttctctatcttgctcaattatacaagccaatactggtttacagcaaagttcttccaagtgcgttctctcaaactagtccatgagggtgataagacgggagaaaaaggttatgagatcaaataactactgaaaacaatagttaaacaaaggtacccatgagtcttcaataaaggactatcaacaccttttctatgctaacatgactctgactctcctagagatagaatgtagattggaacatttcccatatttatttgaaaatataactttttgttaaaatattctaagattattaaaaaaagtaacttttttgaatgaccaggaattgttttttctaggatataagtatctttgggtagaagagaaaacaaacaacgtcaaggcaatgcagtttttatgttagtaaagtgttacttcattatctactgtgtgcaggttactatttaaactattttatatacaacttaaaatacaactacaattgggttccctatcttattattccaaatgcgtgattacaaattaacaaccatattcagaaacttattatttcaaagaagttggacaactgctttgtgtataagaaaggctgagtgtttggagttaaattcccagttctgattattttcttcctgttttgaggcggaaagggagaaagaatggagggagacaggatagggaagtactggcatcaagatggaagtcaggaggctagattctgttcctggttctgtttcataatcctgggtgaggcacttaatcttcagagtttcagtctactcatctgtaaagttaggggctcagtaaaatgatatgtaagatcctctgcttctaagcattcttgaccaaaaaaggtaggagaatcagaggaagaaaataaaagttcatgtgaggtcttcaagctgtgtgagcacaacatttactcccatggcaagactgagggacagaataggtagtcttcaactggctgaccattgaggattttgcacatgggactggatgtaaataggtggcatgcacataatgttatagcagttctacctagacaagatcatctggagtttcagcctccagaggtttgtccagggacaaaatagggtgcctaaagtttaccttctaacgagtcctctaatccaagaactcaatgctcttcttttaactgctagaagagattattcatatgaagctcataagagatttaaattgtaaccactgctgggataatttggtttgtttgtttgtttgtagtgtggcaaaacaggaggccatacttaaaaagaagaagcaataattattgatagaattgcaggcaatgtcagagagtttaagactggagaagaagtcctgctccctccacaaaccacagcacagtgtcataccctgatgtcgaagccagattgcagaaccatactaagagaatatggaattttctgcaatttatgatacagaactccatattttttcagtacgatacagtgacccagcttgatcatcaaggtatcacatcgattgatgtcccttgcttgaatcaagtattaaattgggggttgcaagatggtgatttgtctgattctgagagagaaagaacaaagaaaccagctaggcaaatagggcaaagtcctcggcagaactgctcttctaacaaagagcagcctgagagatcaagccgcaaacatagaaaaggaagcaagctccagcacaaaagagtgccttctgtgtaatcagcaaatttcaaatttcatatacattcagttggcctcagtgaacacattcctttccttttttggttatattcaaataaggaagcttgctcaggagggcatgcttggaacatgcctacagctacacagataaggggagttacactgagctaggcatgtccacaatggaggattctatccccaacacgtgcacagtaagggaagtcaaacaacatgaagtaacttaggctacgagcccacatgcacactggaaggacagcgtgggggttgtcagaaattcatgccttctgcaaatgacacacctagtcctaaccagtttttcacaccttatgtaaataaagtaccccctccccactagctcatttataaaaacccttgtattccactatagaatagcaaccctttttcagggcccctctctgcagcagagagctttctctccttctttcatttattaaacttctgctctaacctcacccttggtgtgtccaccttccttgatttcctcagttgtgggaccaagaactccgggtggcatcccagacaatgaggcctatttcaatgctatcattccttctgtaatgactagacccctccctattcaactagcctcactagttttttagtgactctgctttctggcacaacaggatgttccatgttcaccactactttaccagctccagatctggagcagctgttcctttcggtggagaaagtactaagaaactaagatatgggcacactgatattgctgactcatatttaacattccataggttttctcatgacttcttttatgtttgtgtctcctttcccctacagtcaaaaccatgtaacataatgtatctacttatttgctctatactaaagtataacaaaacagtctcagaacttcagtaccagtatttccactatctacaaaaagagtccaactttgtaaaatagttgaagagatttattctgagccaaatatgagtgaccacggcctgtgacaaagccctcaggagatcctgagaacatgtgctcaaagtggttggtgtgcattttggttttatgcattttagggagacatgagacttcaatcaaatacatttaagaaatacattcatttggtccagaaaggtgggataacttgaagcgtggggtggaggggttcagctgggagatgggtaagggataaaagactacagtcaactgggatcaataaaaaggaatgtctgggttaaaataaaggattgtggaaaccaaagttcttatttgcagaggaagccttcaggttgtaggcttcagagagaatagattataaaatgtcaattctaatacagtggtatttgtgtatctaaacatatctaaacacagaaaaagtaaagtaaaaatatggtatgaagatttaaaaatggtgcacttgtattgggcaattaaccatgaatggagcttgcaggactggaaaatgagtctaggtgagttaataagtagtgagtgaatgtgaaggcgtaggtcgttactgaccacgactatagacttcatgatcactgtacacttagactacactaaatttatttaaaattgtttcctttttccataataaattaaccttgcttactataacttttttactttataaacttttagtttttttaatgttttgactcttgtaataacacttagcttaaaatacaaacatcatacagctgtacaaaaatttcttcctttatatccttattctataagcttttttctattttaaacatttttaattttaattttttactttttacgctttttccttaaaatctaagacacaaacacacacaccctagtctaggcctacacagggtcaggatcattaatatcactgtctttcacttccatatcttgccctactggaagttcttcaggggcaataacatgcatggagctgtcatttcctataacaatgtcttcctctggaatacctttttgacagaactgcctgaggctgctttacaattaacttgttttttaataagtagaaggaacacaatctacaataatgataaaaagtatagtatagcaaatacataaaccagtaacatagtcatttgttaccaagtattatatactatgcatgattgtatgtgctatacttttatacaactggcagtgcagtgggttgtttacaccaccatcaccacaaacacgcaagtaatgaattgttctaggatgttatgatggctacaacagcactaggtgataagaatttatcagctccactataatcttgtgagaccaccattgtatatgtgcaatccattgaccaaagcctcattatgcagtgcagagtaccatatcctagcatgaatgcatagttagaatactacgttcaaactttactgaaataattatttcctctatatggttatgttaccaatttggtagtgagctagccacagttgtttccgtttgtttttaagttgagacaaatgaactaatattatattttaatccaacagaatactgaaaaatgaagcctaaaatgaagtattcaaccaacaaaatttccacagcaaagtggaagaacacagcaagcaaagccttgtgtttcaagctgggaagtaaggacttaagttatctctgaatgttttacgcactatttttatctgttatcaaatatttatactccaatgtttatacatgctatcttatcaaaatctactaagaatacaagaactaaaataaaaagagatggcacataagggtataatacagcagactggttttgaaccaaccatatatagccaactttggcatatttgatacatcaccaggcaggaatagctgagataatctgaacctgtgaatagtgataaacttaattatagccttttatatcaaccactttttgctccacacacctcctgctgccaaacccccaaaaccttttccctgataaactagcaaacttttaagcaggtccacttttattcaacaaatattcattaagacctttggtggtatcaggcatgtggtcttaacttgcgactactgatgaagaagagaataacagatgaagatatttgaataatcatcttagtcaatttgtgttaccatagaaatatacctgaagctgggtaatttaaccctttttccatttagaaaaaaaagtgcagcttgctgccagcgcttatttaattttacataaacatctctttgaggctgaagcaaatctgattttcaatgcaaaaatagaatacaaaaactgttcttggagttatttctaaacagaactaccatcagcattgtctatttcagaaaaaatgagattcaccaaatgaaacttcagcaagcaactaactgttcaagaagtgttcaagaatgttaacatcacatgtaggaatgctacattttccaggatttgacattttcagcgatcaagaattactatattttatcaatgaaaataccactactaaaaacataaatagaatgatgtcttttgtttccaaagttgatatactagagagatgtaaaaataataataaaagcaagatctttcgtggcaaagttatcttaaacactgcagaagcactgccagtaattattctctgggcaaatgggaaagggttaaaaacaaaagaggtttatttggtttacagttctgcaggctgtacaagaagcatggtgctagcatctgcttctggtgagggcttcaggctatttccactcatgatggaaagggaagggaaaccagtatgtgcagaggtcacatagggggagaacagagggagaacagaagcaggagaaagaggagaggagggaccaaccttttttcaacaaccatcttgcaaactaagagtgagaattcgctcttgtgagaatggcaccaagctgttcatgagtggtctgccccatgatccaaatacctcccacaaggccccacctccaacaatggggatcaaatttcaacaggagacttggtgggaccaaaccaaccaaagccaaaccatagaaataaagcagaaccaacaaatgatgctcaagtctatctagctgcaaactcagagtttgtagtaagacagaaggtaagtaaagtcaggtggcagctatagctctgagattaaagggctgtataactctttgatccttaaaattatctgtcctaggaaagaagcatgcaaatttatttatttatttattttctgttgagacagtctcactttgtctcccaggctgaagtgcagtggcaccatctcatctcactaaaacctctgcctcctggttcaagcgattctcctgtctcagcctcccaagtagctggaattacaggcacacaccaccatacctggctaattttttgtatttttagtagagatggggtttcaccaggttggccaggctggtcttgaactcctggcctcaagtgatccacccgcctcagcctcccaaagtgctgggatcacaggcatgaaccaccgcacttggccagaaagcatgcaattttaggatctgtttttcatatgggagtagtaacacaaaagtaagttaatggagccttggtgaacaggaaagaaaatggaggataaggaatgatggtggggactggcataaccttgtccttcatgctcctttccatttctctgtacatctttaaggctagaaaagaaagcagagttaatatcatttctgtctcattctgtcttccctgaggctgtggcccacccacactgttctttggtgaccagggaaagcactaatttgactgtggtttctgaacaaccaggaaatcacagcagaaccaatccttttacttgtagctgagtcaaaatgctctctgtagaaacagtgactcagtgactttgcatccctaaattgcctctcataaaaagtacattttctttgtacctcaggaagtatgggctctttatagaaactggaatgagggagtgggctagagtttatgccagagttggtggtattgatacaaaagttaaaatgtaacccctcctttaagggaacagtggccctaactacttacctataccatttagaggacagtgataaaaataatctcaaactcatttgtatggctttacaaatacatcacattattttaattggcccttaacagatctttctttccaataatattggctcagttaaatattgtcctcccctcttatttgcaggaaatatgtaccaagacacccaacagatgcttaaaacaatggatagtaatgaaccctatatatactatgttttttcctacagatacatacccatgataatgtttaatttataagttaggcacaatgagagattaacaataaccaacaaaaaagtggagcaattagaacaacatactgtaatgaaaataatgtgaatgtctgctctctctctcaaaatatcttattgtatttcactgtgggtaactgaaatcatggaaagtaaacccacagatgggggcaagcaggatagagttactgcactaaaactgtgattatttaaacaatcctggtgaaaaatttgacagatatctctggggtatgtgacaggtgtaaactgcttctcaactcaaaatgcaagatatgtcatatcttgtttttctaaataagctgctgctctaagatgccaagacacaaggcaagaaagcacatttaattccttctcttctcttgagctaccaggatccaacacaagccacagttcacaatgctacaaaacttagtagccaaccactgcaggtgtccccacagtcagtcccacattgtggtcacccacagggcattttgcctctaatgccagcagggtacaggacttcatgacctggaggaaagcctctcacaacccttcccttccccgtttccaggaagctacttccctacttcccagggtcaggctttcctcttctcctactttctttcccccacatccatcaacactttctcttccctaaaaatccagccgtcttcattcatggatctagccagaggtcacaatatgggagccttgggatagatccatccagcaggagtattttattaggattgaacggtgttattgatattttctaattgagtcaatttttaaaaaataggatatttttaatgaaaatctaaatgtgtatagtttctctaaaaaaatccaaagatctagaaacactgggtccatatcttgcatggcaatagttggctagaactgagtagagatcaacccctttagtttgagtctatccatagaagatctgttacagtaaaggagatttgactttatcctgtagacagtagggaatcattgaaaatgttgaactgaggaatgataaaatatttttactttacagagatcacattggtgaagtgtgatgatagtagtgtgatgataaagtgaggaggcaagagtagaaacagaaactggttagaggtctactgcattaatctaagggactaatgatgaaggtgtgacctaagacaacagaatagagaggacggactagatttcagatatattcagaaggtgaaatcaaaaagacttaatgacagattgaatgaattgtaagaatggaaagaaggaaaaataaatgattctcagctttttgatttaagaattgggtagacgccaggtgttgtggctcaagcctgtaatcccagaactttgggaggctgaggcgggcggatcatgaggtcaagagattgagatcatcctggttaacacggtgaaaccccgtctctactaaaaaatacaaaaaattgcctgggcatggtggcgggcgcctgtagtcccagccacttgggaggctgaggcaggagaatggcatgaactcgggaggcagagcttgcagtgagccgagatcacgccactgcactccagcctgggtgacagagcaagactctgtctccaaaaaaaaaaaaaaaaaaaaaaaaaaaaaaaaaagaattgggtggataatgatagatagttgtactatttctcaagataggcaattcaggagaaatatattgggggcagaaaaagataaagacattttttattataaggactgccatggtttgaatgtcccctccaaaactcatgttgaaatgtaattaccattgcgatagtattaagaggtggaaccggctgggtgcggtggcttatgcctgtaatcccagcactttgggaggccaaggtgggtggatcacgaggtcaagagattaagaccatctttgccaacatggtgaaaccccgtctctactaaaaatacaaaaattagctgggcaccgtggcgcacgcctgtagtcccagctactcaggaagctgaggcaggagaattgctggaacccaggaggcagaggttgcagtgagccaagattgcaccactgcactccagcctgacaacagagcgagtctccatctcaaaaaaataaaaataaaaaaaaagagaggtgggacctttaaggggtgattaggtaataaaggctctgccctcattaatggattaatgccattgtcatgggagtgggttagttattacaggattgggtttctgataaaaatgatgaagttcagtccccatcctttctttgcctcatgtgcactctcaccatgtgtgatgtcttccaccatgtgatgacacagcaagaaggccctcatcagctacagcccctcaatcttggacttctcaacctccagaaccagacaccaaataaaactcttttctttataaatcacccagtccatggtattttgttatggcagcagaaaagagactaagaccagtgtactttagtttaaggtagctgcaggtcacccaggtagagatatccagaattcagaagatatacacagaaagagacagctatgcttcaaagtagctgggtcaaaatgacttggggagaaagaaaaacagatagaaagctcaggaaaaagaccaaagatagagttacagtttggggagtcatcagcctctaaaaaggtgattgaagtcattggagcaagcatgattgcccaggaagaaagtttaagagtgagagaagaaaaaaagtcaaaaccctgaggaaaaccaacatttatgagcagacagtagagggataactaacaaagagacaaggtgcagtagtcagagagaaacaagaagaacctagggaaactggtgacatggcataaggaaagaggggttcaaagaaagaagtggtcctgagagtccaatgccacagacaggtcaagggtagtaagcagttaagaagacaccttggtaaaatccgtgcttggggaagaaacgaaagacggagtgattcacctctgtggtttcctatcagccatagtctagttctctgagtggcagaattatagaaagatttccagggcccttcctatttactcacaagaaatccctgagggattcatgctgctgttatgattaaattagctatgggaattttcttaaaattcatactaagccattgccctcagcgagcaggcaggatagagacatggaaagtggtaacagcccttatatacatttgagctggctctttgaccccagtggagtgctctctcctgcaaagtccacatgtccaggccagctttgcactttcctctccagaacacaaccctcacactttcagcttcccaaaacaccaaagcatatgttcttcaaaattctcctgatgcaaagtgttttcaatacttcaaatgtagtaacccccatccttgaactataaccagtgcttgtcctactagatgctagcccccacatgtacatctttaactttcttatctcctaaagacttccacatcttcagtacttcctcagtattgtgaccctcacttttaactacccaagactgatatcctgttccccccagagtccacactcagtattaggcatgcctatcacgttcccatgtgatgctgactaaaatataaagaatataaggagtgagtgttctttcagttatcatattatgccttttagctctgaaaagacaatgtgatatagttgctatggtttgaatgtttccaccaaaactcatgctaaaatttaatcaccattgtaacagtgttgagaggtcagatctttttttcttttcttttctttttttttttttttttttttttgagacagagtctcgctctgtcgccagactggagtgcagtggcactatctcagctcactgcaacctccggagaggtcggatctttaagatgtaattaggtcatgagaactccaccatcataaacagattactgctgttatcatgggagtggtttggttatcaagagactgggtttgttataaaagtgagttctccggatttcctctctgacttactcactgctgccttccaccatcagatgatcctcaccagatgccagcataatattcttggatttgcctgcctctagaagtgtaagaaataaatttctatcttttttttctttttttagagacagggtcgcactctgtcacccaggctggagtgcagtggcatgattatagctcactacagcctcaaactcccaggctcaagcaatcctttggtctcagcctcccaagttgctgagactacaggagcaggccaccatgcccagctactttttttttttaaattttttgtagagacggtcttactgtgttgcccaggctggtcttgaatgtctagcctcaagcaattttcttgcctcagcctcccaaagtgctgggattacaggtgtgagccacagcacctggccaacaaatttctttgctttataaattaccaagtctatggtattctgtgatagtagcagaaaatgaattaatacaacagtcagtaaagtattgtattaaattacttgtcaggagaataagtacaatgctggctctggcactagttttctttatgaattatctttgtaagtgtaaaagcactaaaatataaatacaagataccaccgttgatatttctgcattaagaatcaatggtagagagttctagagtgggtgtgaatataattaagtggtctccccttattaaatcagttgaagatagttaaaggtacctactcatctgaattggaagcaagatgtggattaattcaaaataatagctaataaaagcttttccacttatctttaaaaagcattattttaggaaggcaaatccactggagaatttttttaactcataaaatgaatcccagagtcacaaataatattttattttctgaattactgtgactaattgaaatttgacttcattgtataaattgcttgataattcatttactacataatgttaaaaattgagatcctatgactcatgtgttacaattttcttttctacctgattctgaaagactttttatgattttccaagtagcaaatttaattttctttttgagacttagatttttctttagcaaaatgaaataattactgaataattaacttttttactttgactgatttaatttgaatttgcattttgttagtccctcaaattgtagtgtagcattttcttagatggcggtaagtggatggtggtggaaagaataggtttgattttaggcacacttcagtcacaacttctcgccagctctgtaatcttgggcaagtgtcatgactcctgagagcctcagattatcatctgtaaaatggggacaataatgcccatcttgcaagattattatgaagaattaaatggagacatatgtaaaatcattagcacagcgtttggcccactgtagacacttagcaaatggtagttattttaatatcagtaacctttgtagacttcagcaatccctccaaaattattaaaagtgttctagacaaggagaaaagattgcacatttcatatgagtaaaagatacccctcaattaggcaaaggttgatatatgttggatacaggttcacactccctcatatggaattctgaaaaccaaaatttttttctaaagacctaaagtttttcagaacttatttgacagcaaaatatgacctaaactcatttcttgttcacatcaactaactcctgatgtgaactaacataaggtctttatttcactttgtgtaaattttcctatgtttcaatataaaattaactaattttgattatggggtgctgcccccatctcttctggggtgctacatatgtgcactatatgctctatattacaatcctaaaatctaaaaaactccgaattttgaaacacagctgagttaaggatttctgataagatactgtgaacctgtacttgctttcttggtctgctacactcaggatttgtagaaggataaagatgaatggaatgaaacagtctcacaagtttttcaattgtttagaatcccaacagaaggccaaagaagtttgccccatgtactttatgaagctccgctctggccttatgataaaaaaggaggcctgttactttaggagagaaaccaccaaaaggccttcactgaaaacaggtaaggggaaccgtacattctctggcaatagtgataagtatctgtttgccttcacttaccacatctaaatatgcaattatttttcctcactccaaggttccttttggaaaatattaagaatgatgaactggtttttagctatttttaaaagggcatataaagaattttcaatagcatgagagaaatgattatgttataatgttaagtgaaaacaaaagatacataactatgtgtaaatatgtttacaatatttttaagtgtttttttaatttaaaggaaataggtttaagcattaatagtgcttgccttttgggtgttgagactgtgggtgactagttttcttcctcctgatctctaatgagtgtgcttctactggggaataagtgtgccaagaggtatcaatccctttggaccatgaagtggccaaagccctggagtcaatcactactctcagcaagcagccttaactgggaatcctcaaaggggcatttgtgcagagtggggattgatggtctatccctaatcccatccggtctgcaggtagaaagcacaaaagacatctggtactcgctgcctgtcaacagcagtctactgtggagtgctttgcctttggtatatcaggggtccagaaatatactagagcacttcatgattcaagtatcacaggtatgactggttacaggggtgatgtgggagtgaggagggaggtatgacacaggaccccggaaagtgctactccaggtagcagtcccaagtctgtgtctttaatgtgtaccagaaacttctgcccatttgcagctgatgtacccatctaatagtatccaaagtaggtgcaaggtagctgttctaataatgtacatgcattctctagttagcactccatcattattttgaaatacttgcaatggattggaatcccatggtcattagttttggtgaaaatatgttatcttttgggaaaaaaacacattttccccccaaatttcaatattttgaccatgaaagaaaagagctattatatttttaaatataattctaacactttatacattttaagtagtagttaagatggttttaaattttatcacttccttgtataaggttccaagttgatgatgacttcaagaagtgaagagatcatcattaaaaaaaaaacttggccaggtgtggtggctcacacctgtaatcccagcactttgggaggccgaggttgatggatcacctgaggtcaggagttcaacaccagcctggccaacatggcgaaaccctgtctctactaaaaatacaaaaatctgttggttgtggtgatgtgcacccgtaattccagctacttgtgaggctgaggcacaagaattgcttgaaccttgacagaggttgcagtgagccgagatcatgtcagggcactctcgcctgggcaacaagagcggctgtctcagaaaaaaaacaaacaaacaaacaaaaaaaaacccaacaaaaaacaaaacaaaacaaaaaaaccaactttacctggaaattgcatttgccatttcaagcattattcctgctataaatgtcctaaattcccagaagcaacactgaagttttctcattaagtatttctaaatcatttactttagaagttcatgtacaaattcagtatgtaacattctccttaatattttgtatactatttttttccaggccccatctgagtagtccctaaatctgctccagtttacctcagcaggctataaaaatattatcattttctatgggtattttgacactttttaaaagttgggagcactgcactaagtgtccctgttatttagccagaggagagaacagggcttatatccgcattctccaggactgtcagaaacttctgggtaactccatactttatagatgaacatttatttatccatgtctatcaaaatacagtcccttctttaccacagtccccagaccaagtggtgtcatgaagtgaaggtttcctcaagcaatgtctgttgctttccattttctttttccccaccaaaccctcccataagcacactcacatggcctcccagggccttcatgcaggacactagcacctttaatcccattcaagggtcacatctcagccttttagctatgtaaaacttgtatcaaaggctttaatctagccaacagtgacatacaaaatgcaactcaaattgcaaaaatgttttttgagggagcattttttaaaaaggttgccaaaagaattgtgcctgacaaatttttgaattcttaacaacaggaatttcacctattacagagtatcttgcttctctaagcacatacaatgatcaatccattacttttgctttggaggatgaaagttatgagatatatgttgaagacttgaaaaaagatgaaaagaaaggtagattattttctttttctataataatgtaataatgactaataaaagtaaaacattttaataaatctaccaaactttaaacaatggattaacttagacatggcaaacaggtcatgctgtgtgctaactctaatgcattggcagtgggtgcctgaatccacttctatgtcaagatggattcagaagctttgtcacgttcatcagagaagaatgctgacattgaaatgcagtatctgttgtgaaagatggaaagaggggccacatgtatttgctatctctaaattatccaccagatctttctagccctattagtatcaccaaagtacaacctttatgccactgctatgaaaaatattttaaatattttaataacaactatattggagaattcatcagagcatattcgtgcatttttgagacctttctcaaaaccacaaaagatttgtttttattgatatataataaaaggggaggatattttctgatgttatgtgtgtgttggaactgaaaacttaacaaaattgtgtctcaccagagggattttatgcattctctttcagataaggtgttactgagttactatgagtctcaacacccctcaaatgaatcaggtaatttggagggctgggtagctgtagtgcttgaattcttaagtatggggtaaagataaatccaaaaaaatcctttttgccccataggaaaaaagatagtctcagaaggttatctccaacccaagctcatggtaaaaccttagattctcagaggatgcattctcatccattttacagcttaatcgttaggataaagttttggctacacttaatacagatccaaaacaagagtggtttatgctagataaaactttctgtcttagccagggctgcaatggctcaacaagttgtccagggaacccatctccttctatcttgtggttctgccaacatctacatggttcaagagtacttgggagcatgacaatgcctggtcagcaggacacagaaaaacagatgtatgcattctatttccctttaagggtacaacctagaagttgcacctaacacttcctcttatctcacattggtcagaactcagttgtattactacacttagccataagaaggcaagctggggaatgttctattactatcccaaaagaggaatgaatattgggtgacactatgagtggctttacatgcagacaggaaagctgatgccccgagaagtaaccattagggtcacaactctccaattaaaaagcatataagaaaactaatttctctccggtttataagtaccctctacttatcagtgcctcttgaacttgggtacaaatacttctaagatacctgttagtgaatgaagtaattattttatgtaacatcttagacttttttcctgggtgttgaattcatttaaataaagatgagttacagttcttaactttatcatttatactttcttaattgtaaggtgacggtgttgatggtaagatgttaatggtaaccctgagtcctacaaaagacttctggttgcatgccaacaacaaggaacactctgtggaggtaaaaaaaaaaaatttatctatatctatatatatgattacagaactgtcatgaatgactccaccaacttgtgtagatttgggtgttggggtattttgcagaaggatttttttgtgtgctattgtatataaagcacaatcacttactacaaatgacttgcttctagagtaaggaagggaggaaagtggcatgtatggctttgctattgaaagtctgctctctgccagcagcagagcatcacctgggagcctgttagaaatgcaggattctaagccccccagaaataaatcagaatcagcatattttaataaatctccaggaaattcatatgtgccttaaagtttgagaagcactgttacatagaatgatctcaaatcctttctgtttggctttaggaactactatgttcctctaggaaacgtttctttgtataatatcattttcttaaacaaatacaaaaaaaatttccattctgagcctgcttaagggagagtcataagcgtttccatgtgccaagatttataaataacctaacatctacattctgaacatagaattaattgcatattcttctttagttagcaaatggcattattacattggtcatgatgtgtaattataactattttgacaaacaagccaaaggtagaggcatggaagaaaacagaagagagcataatatagaagataaattatacaaacacagaaaaatataaagctaactaacacagccatgtaaggccttattaacataaatagtggatagtaaccagcatcttcctaagcaaaacattcctaaacatatataatctagtgtttggcatgtataactactcaataatagagctacttagactgagctctattatatagcaagcactgggctaaatgttttacaaatattattttatttaatactcacagtaactctacaatggagttgttgtattggtcaactgttgctatgtaacaaaccatcccaaaacttagtgcctcaaaataataatcatttatatttactcatgtctgtagatattttgaggattgactgatctagaaaactggttagactaaaaaaaatgaggcttgagagataaagcaacatccccaagatctcagagatagtacatgtcaaaagaagggtacaaatccagaactgttgcatccagatccaatcaccctaatccatactgcctctctatgttgactatcagtgaatcaaatcaaatccacccactacccctctggccctctactcacttctccccctcttccctccacaactcactaagcaagcttgctagaaatatcaagtcataaataagtattcccctttagtttccaatacaggcaggtaaagttgactctgaacttcccattcacatatggattgctttctctcttgtttcctcagctccataagtgtgaaaaaccactgccagaccaggccttctttgtccttcataatatgcactccaactgtgtttcatttgaatgcaagactgatcctggagtgtttataggtgtaaaggataatcatcttgctctgattaaagtagactcttctgagaatttgtgtactgaaaatatcttgtttaagctctctgaaacttagttgatggaaacctgtgagtcttgggttgagtacccaaatgctaccactggagaaggaatgagagataaagaaagagacaggtgacatctaagggaaatgaagagtgcttagcatgtgtggaatgttttccatattatgtataaaaatattttttctaatcctccagttattcttttatttccctctgtataactgcatcttcaatacaagtatcagtatattaaatagggtattggtaaagaaacggtcaacattctaaagagatacagtctgacctttacttttctctagtttcagtccagaaagaacttcatatttagagctaaggccactgaggaaagagccatagcttaagtctctatgtagacagggatccattttaaagagctacttagagaaataattttccacagttccaaacgataggctcaaacactagagctgctagtaaaaagaagaccagatgcttcacagaattatcattttttcaactggaataaaacaccaggtttgtttgtagatgtcttaggcaacactcagagcagatctcccttactgtcaggggatatggaacttcaaaggcccacatggcaagccaggtaacataaatgtgtgaaaaagtaaagataactaaaaaatttagaaaaataaatccagtatttgtaaagtgaataacttcatttctaattgtttaatttttaaaattctgatttttatatattgagtttaagcaaggcattcttacacgaggaagtgaagtaaattttagttcagacataaaatttcacttattaggaatatgtaacatgctaaaacttttttttttttaaagagtactgagtcacaacatgttttagagcatccaagtaccatataatccaactatcatggtaaggccagaaatcttctaacctaccagagcctagatgagacaccgaattaacattaaaatttcagtaactgactgtccctcatgtccatggcctaccatcccttctgaccctggcttccagggacctatgtcttttaatactcactgtcacattgggcaaagttgcttctaatccttatttcccatgtgcacaagtctttttgtattccagcttcctgataacactgcttactgtggaatattcatttgacatctgtctcttttcatttcttttaactaccatgcccttgatatatcttttgcacctgctgaacttcatttctgtatcacctgacctctggatgccaaaacgtttattctgctttgtctgttgtagaattttagataaagctattaatggcaatatttttttgctaaacgtttttgttttttactgtcactagggcaataaaatttatactcaaccatataataacattttttaactactaaaggagtagtttttattttaaagtcttagcaatttctattacaacttttcttagacttaacacttatgataaatgactaacatagtaacagaatctttatgaaatatgaccttttctgaaaatacatacttttacatttctactttattgagacctattagatgtaagtgctagtagaatataagataaaagaggctgagaattaccatacaagggtattacaactgtaaaacaatttatctttgtttcattgttctgtcaataattgttaccaaagagataaaaataaaagcagaatgtatatcatcccatctgaaaaacactaattattgacatgtgcatctgtacaataaacttaaaatgattattaaataatcaaatatatctactacattgtttatattattgaataaagtatattttccaaatgtatgtgagactataatgattttatcatatgatgactcaatattctgaaatttctttttttattatactttaagttctagggtccatgtgcacgacatgcaggtttgttacatatgtatacatgtgccatgttggtatgctgcacccattaactcatcatttacattgggtatatctcctaatgctatccctcccccttcccccaccccacaacaggccctggtgtgcggtgttccccactctgtgtccaagtgttttcattgttcaattcccacctataagtgagaacatgcagtgtttggtttttagtccgtgcgatagtttgttcagaatgatggtttccagctccatccatgtccctacaaaggacatgaactcatcctttttatggctgcatagtattccatggtgtatatgtgccacattttcttaatccactctatcactgatggacatttgggttggttccaagtctttgctattgtgaatagtgccgcaataaacatacgtgtgcatatgtctttatagcagcatgatttataatcctttgggtatatacccagtaatgggatggctgggtcaaatggtatttctagttctagatccttgaagaatcaccacactgtcttccacaatggctgaactagcttacagtcccaccaacagtgtaaaagtgttcctatttctccacatcctctccagcacctgtttcctgactttttaatgttcaccattctacccggtgtgagatggtatctcattgtggttttgatttgaatttatctaatggccagagatgatgagcattttttcatgtgtctgttggctgcataaatgtcttcttttgaaaagtgtctgttcatatactttgcccactttttgatggggttgtttgagtttttcttctaaatttgtttaaattctttgtagattctggatattagccctttgtcagatgggtagattgcaaaaattttctcccattctgtaggttgcctgttcactctgatggtagtttcttttgctgtgcagaagctctttggtttcattagatcccatttgtctattttggcttttgttgccattgcttttggtgttttagacatgaagaccttgcccatgcctatgtcctgaatggtattgcctagggtttcttctagggtttttatggttttaggtctgatatttaagtctttaatccatcttgaattaatttttgtataaggcgtaaggaagggatccagtttcagctttctacatatggctagccagtttccccagcaccatttattaaataggcaatctttccccatttcttgtttttgtcaggtttgtcaaagatcagatggatgtagatgtgtggtattatttctgagggctctgttctgttccattggtctatatgtctgttttggtaccagtaccatgctgttttggttactgtagtatagtttgaagtcaggtagcgtgatgcctccagctttgttcttttggcttaggactgtcttggcaatgcgggctcttttttggttccatatgaactttaaagtagttttttccaattctgtgaagaaagtcattggtagcttgatgggatggcgttgaatctgtaaattaccttgggcagtatggccattttcatgatattgattcttcctatccatgaacatggaatgttcttccatttgtttgtgtcctcttttatttcattgagcagtggtttgtagttctccttgaagaggttcttcacatcccttgtaagttggattcctaggtattttattctctttgaagcaattgtgaatgggagttcactcatgatttggctctctgtttgtgtgttgttggtgtataagaatgcttgtgatttttgcacattgattttgtatcctgagactttgctgaagttgcttatcagcttaaggagattttgggctgagatgatggggttttctaaatatacaatcatgtcatctacaaacagggacagtttgacgtcctcttttcctaattgaataccctttatttctttctcctgcctgattgccctggccagaacttccaacactatgttgaataggagtggtgagagagggcatccctgtcttgtgccagttttcaaagggaatgcttccagtttttgcccattcagtatgatattggctgtgggtttatcatagatagctcttattattttgagatacgtcccatcaatacctaatttattgagagtttttagtatgaagggatgttgaattttgtcaaaggtcttttctgcatctattgagataatcgtgtggtttttgtctttggttctgtttatatgatggattaaatttatggatttgcacatgttgaaccatccttgcatcccagggatgaagcccacttggtcatggaggataagctttttgatgtgctgctggattcagtttgccagtattttattgaggatttttatatcgatattcatcaaggatattcgtctaaaattctctttttttgttgtgtctctgcccagctttgttatcaggatgaagctggcctcataaaatgagttagggaggattccctctttttctattgattggaatagtttcagaaggaatgttaccagctcctctttgtacctctggtagaattcagctatgaatccgtctggtcctggacttttttttggttggtaggctattaattattgcttcaatttcagagcctgttattggtctgttcagggattcaacttcttcctggtttagtcttgggagggtgtatgtgtccaggaatttatccatttcgtctagattttctagtttatttgcatagaggtgtttacagtattttctgatggtagtttgtatttctgtgggatcagtggtgatatctcctttatcattttttattgcgtctatttgatttttctctttttctttattagtcttgctagaggtctatcaattttgttgatcctttcaaaacaccagctcctggattcattgatttttttgaaggtttttttgcgtctttatttccttcagttctgctctgatcttagctatttcttgccttctgctagcttttgaatgtgttagctcttgcttttctagttcttttaattgtgatgttatggtgtcagttttagatctttcctgctttctcttgtgggcatttaatgctataaatttccctatacacactgctttaaatgtgtcccagagattctggtatgttgtgtctttgttctcattggtttcaaagaacatctttatttctgccttcattttgttatgtacccagtagtcatttaggagcagggtgttcagtgtccatgtagttgagtggttttgagtgagtttcttaatcctgagttctagtttgattgcactgtggtctgagagacagtttgttataatttctcttcttttacatttgctgaagggtgctttacttccaactatgtggtcaattttggaataagtgcaatgtggtgctgaaaagaatgcataatctgttgatttggggagttctgtagatgtctattaggtccacttggtgcagagctgagttcaattcctggatatccttgttaactttctgtctcgttgatctgtctaatgttgacagtggggtgttaaagtctcccattattactgtgtgggagtctaagtctctttgtaggtctcttaggacttgctttatgaatctgggtgctcccatattgggtgcatatatatttaggatagttagctcttcttgttgaattgatccctttaccattatgtaatggccttctttgtctcttctgatctttgttggtttaaagtatggtttaccagagactaggattgcaacccccgctttttttttgttttccatttgcttggtagatcttccaccatccctttattttgagcctatgtgtgtctctgcatgtgagatgggtctcctgaatacagcacactgatgggtcttgactctttatccaatttgccagtctgtgtcttttaattggagcatttagcccatttacatttaaggttaatattgttatgtgtgaatcttatcctgtcattatgatgttagctggttattttgctcgttagttgatgcagtttcttcctagcatcaatggtctttataatttggcatgtttttgcaatggctggtaccagttgttcctttccctgtttagtgcttcctcaggaactcttgtaaggcaaggcttgtggtgacaaaatctctcagcatttgcttgtctgtaaaggattttatttctccttcacttatgaagcttagtttggcaggatatgaaattctgggttgaaaattcttttctttaagaatgttgaggccgggcgcggtggctcacgcctgtaatcccagcactttgggaggccgaggcaggcggatcacgaggtcaggagatcgagaccacggtgaaaccccgtctctactaaaaatacaaaaaaattagccacgcgcagtggcgggtgcctgtagtcccagctactcgggaggctgaggcaggagaatgatgtgaacccggaaggcggagcttgcagtgagcggagatcgcgccacagcacttccgcctgggcgacagaacgagactccgtctcaaaaaaaaaaaaaaaaagaatgttgaatataggcccccactcttttctggcttgtagagtttctgccgagagatccgctgttagtcttatgggcttccctttgggggtaacctgacctttctctctggccgcccttaacattttttccttcatttcaactttggtgaatctgacaattatgtgtcttggagttgctcttcttgaggagtatctttgtggtgttctctgtattttgtgaatttgaatgttggcctcccttgctaggttgaggatgttctcctggataatatcctgcagagtgttttccaacttggttccattctccccatcactttcaggtacacgaatcagacgtagatttggtcttttcacatagtcccatatttcttggaggctttatttgtttctttttactcttttttctctaaacttctcttcttgcttcatttcattcatttggtcttcaatcactgataccctttcttccagttgatcaaatcggctactgaagcttgtgcatgtgtcacatagttctcgtgccatggttttcagctccaccaggtcatttaaggtgttctctatgctgtttattctagttagccattcatctaatcttttttcaaggtttttagcttctttgcgatgggttcgaacatcctcctttagctcagagaagtttgttattaccgatcttctgaagccttcttctctcaactcgtcaaagtcattctctatccagctttgttccattcctggcaaggagctgcgttcctttggaagagaagaggcactctgatttttagaattttcagcttttctgctctggtttctccccatctttgtggttttatctacctttggtctttgatgatggtgacgtacagatagggttttggtgtggatgtcctttctgtttgttagttttcctcctaacagtcaggaccctcagctgcaggtctcttggagtttgctggaggtccactccagaccctgtttgcctggttatcaccagtggaggctgcagaaccacaaatgttgcagaatggcaaattttgctgcctaatcattcctctggaagctttgtctcagaggggcacctggatgtatgaggtgtcagtcagcccctactgggaggtgcctcccagttaggctactcaggggtcagggacccacttgaggaggcagtctgtcagttctcagatctcagacttggtggtgtgagaaccactactctcttcaaagctgtcagacaggaatgtttaagtctgcagaagtttctgctgccttttcttcagctatgcccttcccccagaggtggagtctacagaggcaggcaggcctccttgagctgcggtgggctccacccagttagagctacttggccactttgtttacctactcaagcctcagcaatggcgggcgcccctcccccagcctcactgccatcttgcagtttgatctcagactgctgtgctagcagtgagcaaggctccgtgggcatgggaccctctgagcaaggcacaggatataatctcctggtgtgccatttgctaagaccattggaaaagtgcagtattaggatgagagtgacccgattttccaggtgccgtctgttatggcttcccttagctaggaaagggaattccccagccgcttgtgcttcctgggtgaggcgatgcctcaccctgcttcagttcacaatccatgggctgcacccactgtcctgcacctactgtccaactagccccagtgatatgaacccagtacctcaggtggaagtgcagaaatcaccgtcttctatgtcgctcacactgggagctgtagacttgagctgttcctattcagccatcttggaaccaagaccccgatattctgaaattcttaagtgaaagtaagcatattccaatctaccaatgttggtatccggagtaggtcattacctgataattttggttattcaaaactaagtaatattttcaagagaagagattgtgtctttttcacctttgtactgtcagtgcccatactggtgggtggcaagaaggtgttcaatgacttttactcagaatcaaacatctaacaggtacctgcaccagaaccttgatctgatcattctgactccttaggtagataactttcaactcagctcacttattttctgtgtttaagtttcctttttttaaaaaaaaaatttccaccatcattatagtcagtataatttgattaaaatattcaaatatgaggtggcatttttgtcacttacctgtatgtgttttcatggtccaaatacacattactggaaagaatttgttcatttcattgtatcaggaaggataattgtgtcaaaacttactttttcctcattttatttgtcttctttaggtttttatgtatttactgactatcttgaaatactgtcaagaaaattttatttgaacgagtaaaatgacttagaatcgggaagaaataagtaagagttgagattcagggggaatttggaaagaaaattgccaacctaatttgaaaacagcagcttgatttaaaactaaaacaatttattcataatccccacttctgcagaacaaaataagccaaaaaataatttcaatccttgtgcctcacactgaaaaatttcatgatggatagaaatcttcagctgcaatcccattactgggtatatacccagaggaataggaatacaaatctttctaccataaatatacatgcacacaaatgttcattgcagcactattcacaatagcaaagacacggaatcaacctaaatgtccatcagtgacagactagataaagaaagtgtggtacatatacacactagaatactatgcagtcatgaaaaagaatgagatcatgtcttttgtgggaatatggatggagctggaggtcattatgaatttataaatacaagtagactggggtctacttgagggtggagggtgggaggagggagatgaacagaaaagttaactattgggtactgggcttaattcctgggtgatgaaataatctgtacaacaaactcccatgacatgagtttacctatgtaacaaaccttcacttgtaccctctaacctataacaaaagtttaaaaaaaataattttaaaaacagaaatcttcagctgtggtatgccagtgggtggttggagtagtaggcttgtcccaaaactccttctcccttcaagtataagcctatacagccctgaaatctcatcttctagcagttatacatcaaataggtgccatatgtactgtgactttgctaggcaccatgacagcacaaaagaaacttaagccatgctccttgttcacatggaaattaaaacatgtaccatatgtattattattattttttttaaacagagtctcactctgtcacccaagctggagtgcagtggcatgatctcagctcacggcaacctctgcctcctaggttcaagcaattctcctgcctcagcctccctggtagttgagactacaggtgcctgccagcacgcccagctaatttttgtatttttttagtagagacagggtttcaccatattggccaggtgggtctcgaactccggaccttggtatctgcctacctcggcctcccaaagttctgggattacaggcgtgagccaccattcccagccccctaaaacgtgtaccatatgtattataactccaactctgcagtacagttgtacaaaggtgagaaagatcagtgtggatttgtcatcagggaaagaaatataactgaattgtctatccccataccctaacacccatccctatctattcttatatccattctcaaggtcttgttaagcaggttcctcatgtaggtcttaggtaaaaggggtaaattcagttgttttaacccctttagtggtcaggattatatatggggacttaggaatctgaggaaataaatcaagagatgaaagtgattgtgagttggtagagggaggatcgatgaattatttcctgctgaagtgccaagatgactgtgatggttaatattaggtgtcaacttgactgaattgagggatgcctacatggctggtaaagtattatttctgggtgtgtctgtgaaggtgttgccaaaggagagtgacatttttgtttgtttgtttgtttttgagacagggtctcactctgtcacctaggctggagtgcagtggagcaatctcagctcactgcaacctcagcctcccaggctcaagtgatcctcccacctcagcctcctggggagctgggactacaggcacgtgctaccacatccacctaatatttgcatttttttgtagagccagggtttcactatgttgtccaggctgctctcaaactcccgggctcaagcgattcgcctacctcagcctcccaaagtgctgggattataggctgagccaccgcatcctgccaagattgacttttgagtcagtggactgaaaaaggaagaaccaccctcaatgtgggtaggcaccattcaatcagccaccagcacaactagaacaaagcaggtggaagaagggtgataaacttactaacttagtcttctcactctcttcccttgccgggcacttgcttcctttcctcctatcctcggacatcagactctaggttcttcagctttggactctgagatttgcactagtggcctcccaggggctcttgggccttcagcctcagactgaaggccacactttcagcctccctggaattgaggctttctatcttggactaaaccgctctaccagcttctctttttccccaacttgtagatggcctattttgggacttcaccttttaatcgtgtgagccaattatccttaataaactcagatagatagatagatagatagatagatagatagatagatagatagatagagtgtatatatacattgtgtgtgtgtgtatatatatatagatatatatatatctatatatatatatctatatagctatatatatatatatctatatagctatatatatatatatatatctatatctatctatctcctactggttctgtccctctggagaaccctgactaatacaaagatgaaatacttgtccaagtttaattacagtccctagcacagaggatgcgcccacaaagagatcacgtgaatcagtgtccaatgtattaagagcagggttggtttgctgcttataggctgtgcaactttggtaaggtaagtaacctctctcaatatctatttctcctctgtaaatagggagtaccaaatattgtaattgtctacctaatatccacaaccaccatccctactgctttaccaatagaccctcatttttttttttttaccagacaacagtgcacacaactaaaaatacactctttcccagattccca

SEQ ID NO: 502 - DNA, 40536 bp, Homo sapiens
aattagtttggtgagcttggacatgacaactctaatctacactcccctaattcacagtgcttttgactttatcatgtatatatatacacacacacacacacgtgtatttatatatggtatacatatttataatatatatttgcatatggtatatatttatatatggtgtgtgtgtgtatatatgtgtgtgtgtgtgtgtatatatatatatatgtgtatatatatatatctttgagacaggctcttgctctgtcacccttcagccttaactccctggctcaaagtgatcctcccacctcagcctcctgagtagctagaactacaaaagtgtaccaccaccacacctggcaaattaaaagaaatttttttttgtagagatgaggtctcactatgttgcccaggctgacttttgatccccatcaaatacttttgaccttactgattcccatcaaacacttagcagtgtttgtttgtttgtctgttttaactgaggtatgacacagtaatatgcgctaatctaagtgtacaccatgataaatttttgcattcgtatatcagcatgtaacccaccaggcagattaagttatagaatacattagcagtgacagactaacctagtggttttactactaccaagtttagaatgagtaagcagcccactgtagtatgacctgatacataaaatgcgagaaagatgcagagttctaccacagttttgagttagaagtcagaataatagatttgctatactatcttttcatgtgctttctggagccatgtatatagaaacaccatgacaaaatagattttaatgttaattaaacatgctttattatatgcaaattaaaaaaatattaagtcccctgtgttagcatactttattactcacctccccgccccccatcagaatcagtgtcagggttcgatatgttgtcctcctctcttgggtgctgaccacagtcactttgggctttttgtttgtctatttgctctaagatggagtctcactctgtcacccaggctggagggcaatggcgccatcttggctcactgcaacctctgcctcccgggttcaagcgattctcctgcctcagccccctgagcagctgggattacaggcgtgcaccaccacgcctgtgtcatttttgtatttttagtggagacagggtttcgccatgttggccagactggtctcgaactcttgacctcaagtgattctcccacctcggcctcccagagtgctgagattataggcatgagtcactggcacccagcctgaccacagttactttggatgcagaagcaaccaatcccaaaaagcagccaagtccatgagagactatggctacaaatcactttttttacagattgtctcatgcttcttatttctgacctgctttaatactatgtaagaaaagcaggtatttggtagtttaaatcatgtgtgtgcataatatattgaccacatctgaagtgaataggtacatctggaaatctaaggtttttgttttctctacatttaacgaacataagtgcacaccacacaccaagatccctgccttgtttcaacattacaaaatggcacacagaatcgtgctaggggttgagccttgtttgcctttgttggagccaacaaactgggcattgtctttgcacagccagtcagagctgtaaatagttgtcaagaatgtgtaaccagacatataattaccaagagtgccctttttcagaccccatttcaactaagtgcattcccctcatttctcatatttgccaggcttgtcggtttctcaagattgcaagcccaaaggcttgagaccctctatatcttagacagcatctattgtgtggttggaattcagcaaatgttgaaaaatagagataattactcataaagcaagttcaagcgttccttgatataatgcccagtatttatttccacttgttgagggggagaatctttgacacagggacttttttccttgaggaaagacagacagccttatgcaggagagtggaacagggtctgggcttctctgcataggctggtgtgacctcacttaaatctgaaatctctctcagcaaaataccagtggttgtaaagctgcatcattccagcgctgtgatcagaggaaacagtgggcaggaaaaccctttgttttcctaggaactgccttttcatcttctggctttcctactgctgtggttctccatgcttctcagggaccactgaacttacagccttgagtgggcaggcagtgcagagccctgatgttacatcctctgttccaggtcttctctgacagacctagggtctttcttggatcccacagaaagacagcaggtggctgcccatgaggtatgtcttgagaagtgaccatgttctacattccccatggtatctccctcgagagcctgtattagaacctgaagtcccctcacctttaaactgctcttcaggtcgggcgtggtggctcatgcctgtaatcctagcactttgggaggccatgtcaggcagatcacttgaggtcaggagttcaagaccagcctggccaacatggcaacacccgctctctactaaaaatacaaaaaaaaattagccgggcatgttggtgcgtgcctgtagtcccagctacttaggagactgaggcaggagaatcgcttgaaccagggaggtggaggttacagtgagctgagatcagccactgcattccagcctgggtgacagagtgagactctgtctcaaaaaaaaaaaaaaacaaaaaaacaaaaaaacaccaaaaactgaaaaaacaaaactcctcctcttataacttggcagagcctttttggagggagtttgacaaaatgttccaagaacctaacaaatattcatagcctttttgtttgtttttggttttttgttttgttttgcttcattgtgttttgagacagagtcttgctctgtcacccaggctggagtatagtggccaatctcggctcactgcaacctctgcctcccaggttcaagtgatcctcctgcctcagcctcccaagtagctgggactacaggcatgcaccaccatgcccagctactttttgtatttttaatggagacgggatttcaccatgttgaccaggctggtcttgaactcctgacctcaggtgatccatctgccttggcctcccaaagttctgagattacaggagtgagccaccacgcccagcctcctagtctctgaatctgccattccttgtcaataatttgcttagggaaattactagcatgtgtggtatttaaaatagtgactgatgagaaacaacctaactacccaaaaccacagaaatggtgaaataaattacattacagtcaatacggccattaaaaattaggttgtaacatggtatttaatgatgtgagaatgttagcaatatatgaagtcaaaagaagcgggttaccaaacagtacaattccgattacatttataaataattaaacctaacatgcttaggaaaaagaacaaagaaaatgtgttagatgttaatgattgttggtgaattttattttttactttatacttttctgtattttcttcaatgaatatgttatttttgaatatatatatattttaaataatgggtcttgctacattgtccaggctggcctcaaactcctgggctgaaaaatatgcctgcctcagccttctgaatagctgggattacaggcgtgagccctcatgcccagcaaatatgtgttatttttataatgagaaaaaacttcataaagttccccttttgcattctttgtgtcaaggaactggatcttccaaggcttggttaagatgcataagttggccaggtgtggtggttcatgcctgtaatcccagcactttgggaggccaaggcaggcagatcacttgaggccaggagtttgagaccagcctggctgaatggtgaaaccccgcctctacttaaaatacaaaaattagccaggtatggtggtacatgcccataatcccagctacttgggaggctgagacatgagaatcacttgaacccgggagatggaggttgcagtgagccaagatggtgccactgcactccagcctggacaacagagtgagactgtctaaaaaaaaaaaacaacaaaacgtaagttacctgaaacttagaggtcaaaaccatgagttgtccagattagtctggtttttaatcctagatttgctattttccaaaagtgcaatcatgggcaagttactcaatgtccttaagtcttggttttctcctccatgaaatagggatgatggaagtgtttgttacacagagcagtgggaggattaaatgaatagtgcaggaaaagtgctgtgtagagtggctggcacctgataaatggggactgctagtaatagtaatagtagtgctgggagagctaccacactctgctgccaactatccatgccacatcagcacgagtagtttaatttatgtgagttaatttctggccgccttcttgtaggacagacaagaggagttgggagtccaagaggctgaggtcccaggagactcagagctggtgggcacacactccccagctggttgggtcagccctgcccatgtcctgtgcaccgagtggggagaagtgatattcttatctcctagcaaaattcacacaaggaaaaactgccccactttaacttttctgtcgtgtaatgttcagaatagctaaataccagctgctgggagaacaacaaattctaatttcctggcttatatgtagtaaggtttcattgtattggcatagctttgccagtttaaggaatttaatttccttagctttttaaacacaaagcactccgaacaagaaaaatggaaataaaagggtataactgcacaatggaatacacataccaatttgaagatgtcattgacattctcataattactcattaaaataaaagcatgcaggccgggcacggtagctcacacctctaatcccagcactttggaaggctgaggcgggggaccacctgaggtcaggagttcgagaccggcctggccaagatggtgaaaccctgtttctattagaaatacaaaaattggctgggcatggtggcatgcgcctgtagtcccaactactcaggaggttgaggcaggaggatcgcttgaatccgggaggtggaggttgcagtgagccaagattgcaccgcttcactgcagcctgggtgacagagggagactctgtctaaaaaataagtaaataaataaataaagaaataataaataaatgcatataacaagagaaataaatatttttactttcaaaggcaagcagcagcaatataaccatatttagggaatataaactcatgcttgctttatccaagtcatgccatagttccttatttatatttttatgtcaagcaattctgtcaaatttagcaaaagacatgattattacaaaaaattaaataaacatccttagatctcaatataaaaaagaaaattatttctagcacggcagtagaaaaagtcaccaaaaaaaagttcaaagccagtaagacactattttaaaacattagctaattcaaaaatatccccaccaaactggatattactcgatgctgaaaaaatattccttttggcaaaatcaacttctatttctaccttagttttcttccttcttttttccctattagtctctgccctgtcatctgttatatgtatgtaaaaaggtctaagaaatttttttacaacctaatatttaaatattattattattatttagagacagggtctcactctgtcacccaggctggagtacagtggcaaaatcatagctcactgctgcttccaactcctgggtttagcctcctgggtagttgggactacaggtgcaggccaccatgcccagctatttttttttttttactttttgtagcaacagggtctcgctatggtgctcaggctggtcttgaactcctggcctcaagtgatcctcctgcctcagactcccaaagtactgggattacaagcatgagccaccctgactgggccaaagatattccttatagtgattcacaaattgtagttacttgttttgtttgtttgttttttgagagggagtctcactctgttgcccaggctggagtgcagtggcgtgatcttggcttactacaacctccacctcccaggttcacacaattctcctgcctcagcctcccgagtaactgggattataggtacccatcaccacgcccaactaatttttgtactttagtagagatggggttttgccatgttggccaggttggtctcgaactcctgacctcaggtgatcagcctgcctcagtggcctcccaaagtgctaggattacaggcatgagccaccgcacctagccttgtagttacttgtttaaaagtcaatctatttgaaaactatggtacagatgaaagtaacttgattgttagaagagagttttgtcagatttatcttgatagattaaaacagtgctatgaacttggtatgtgcctaattacaatagtccccccttattcacgctttcgctttcagtggtttcaggtacctgtggtcaactatggtctgaaaataagtgactactgcacaataacaattctgagagaaagggagagccatattcacataacttaatgaacatggtctctcccacattccggagcaagagagagtgagaataggggagaggtgccacacacttttaaaggaccagatcttgcaagaactcactcactatcgtgaagacagcaccaagccatgaggaatctgcccccatgacccaaacacagcatattattataatagttctatttttagttattgctgctaatctcttactgtgcctaatttatacactaaactttatcacaggtatgtatgtataggaaaaaacatagtatatttaggattcgctactatctttggtttcaggagtccccatgtgtcttagaacatatcccctggaaacaaagcgggagactactataaatacatgttagacaatgagaggggtggctagagagaaagtgaggggtcacagcaaaaactacccaaagcaccactttcctaaaccacccatgtgctaaagtatggaaatcatcacattagggtgagaaagaataagggtcttcaattgccgcatgaaacatcaaaatctgccaggtgcggtggctcacccctataatcccagcaccttaggaggctgaggtgggtggatcacgaggtcaggagtttgagaccagcctggccaacatggtgaaaccctgtctctactaaaaatacaaaaattagctgggcatggtggcatgcgcctgtagtcccaactactctggaggctgaggcaggagaatcgcttgaacccaggaggtggaggttgtagtgagctgagatcgcgccactgcatgccagcctgggcaacagagtgagactccgcctcaaaaaaaaaaaaagaaaaaaaagaaacatcaaaattgttaaaatcactgctatggtttgaattttgtctcccccatatccccaaaaagatatgtttaagtcctaacccccagaacctcataatgtgacctcatttggaaacagggtaattgcagatataattatggcggtacctgcggcgaatccctacaggtctgcagcaaccccaattattgcctcctcagaagaaagaatttgactgagcggcataaggcagaaggagagaccgaggcaagttttagagcaggagtgagtttattaaaaagctttagcgcaggaatgaaaggaagtaaagtacactccgaagagggccaagcgggcgacttgagagatcaagtttgtagtctgaccgttgacttggagtttttttgtttgttttctttttcagacggagtctcgctctgttgccaggctggagtgcagtggtgtaatctaggctcactgcaacctccgccgcccggattcaagcaatttccctgcctcagcctcccgagtagctgggactacaggcacgcgccacaacgcccggctaatttttttgtattttagtagagacaggatttcatcatgttggccaggatggtcccgatctctgacctggtgatctgccagtctcggcctcccaaagcgctgggattacaggcgtgagccactgcgcccgacttgacctggggttttatatgttggcatgccttgggggtctggggtggaggtggggttgcctcccttctttcctaattcttcccttggggtgggctgcccgcatgtgcagtggcccgctagcacttggtaggggagcatgcagtgtgtttactggagttgtacccatgcttgcctgaggtgtcctgcccttaccagtctagcattcctagaggaaggtcatgtaccagttaaactctaccattttgtctcttaatgtgcatgattaagcccactcgcccaactcctgagattttatgggaagctgctgatcaccagttttaggtgttttctgttttgggaggtggaccttccctggtgcctgctgtgaacaattattattttagagagacagttaacaaaaccgtctgaccatcacttgatggtcccctgacactcctggtgtgtgtacgtgcgtgtgcgcaggggtgggggtcaaggtggggaagtggggtggggtgggagttgggggagcccttttctgccttgctcatacctgtctggctacctactgtaacaacgggtcatactggagtagggtgggcccttaatccaatatgactggagttcttgtaagaagacagccatatgaagacacagacacacagggtgagcagcatgggatgacagaggcagagatgggagtgatgcagctgcaagctgaggaacagcacatgctggcaacccccagaagccaggaagaggcaaggaaggacccccttccaggctttagagggagcaggtcctgctgacctcttaatctcagactcccagcctccaggactgcaaggcaacacagttctgctgttttaagccatgcagtctgtggtactttgagtagccctaggaaattaatacaattactttatttcattttattttaaaagctatttaaggccgggtgcaggggcttatgcctataatcccagcactttgggaggctgaggtgggcggatcacctgaggtaaggagttcaagaccagcctggccaaaatggtgaaacccccatctctactgaaaaaaaaaaaaaaaaaaaaaaaaaaaaaaaaaattagccaggcctggtggtgcgtgcctgtaatcccagctactcgggaaggctgaggcaagaggatcacttgaaccagggaggcggaggttgcagtgggctgagattgcacctctgcactccagcctgggcaacagagtgagactccatcttgaagaaaaaaaaaaatacacattttgaaaggaaaaaaaacagttttgtcagtgaaaaactactaaaatttcatgtatttcttccattatctttcctctgaatagttttaaaattttacatggctatgaccataatctcatacaaattttgtagtgatattttcaatttatattgtaacattcattctctatgttattacaaacttttgtaaacatcctttaaatttttcaatgtagtcaatgttgcctagattattgtttggcagctttcttttagatttctatttttattattatagacagtctcttgtatctgactcttgaaggagttaaaaatgctttagattatcttatcagttccctaaaatgtgctctgagtgaaataggaggtaggctatttaattaaaaagcaggctaccaaatagaccctaatagactgagctcacacttaaataaactggaatggggtcacaactcactctcaggtctatgtgttagtatgagaaggaagtgtcagataattaatgcatacttagtcccaagataccaggttgggtgatgtaaccactataacggtagattctggtagaaccaaatccaaagcccaagttcctggattccctcccttgcatcatttcttttttctttttctttttttgagatggaatctcgctctgtcgcccaggctggagtgcagtggcgggatctcagctcactgcaagctccgtctcccgggttcacgacgttctcctgcctcagcctcctgagtagctgggactacaggtgcccgccaccatgctcagctaatttttttttttttttttgtatttttagtagagacagggtttcaccgtgttagtcaggatggtctcgatcctgacctcgtgatccgcctgcctcggcctcccaaagtgctgggattacaggcgtgagccaccacactcggcccctcccctgcatcatttctatttctttactcaggtcatgacaatgattacaaaaaatgtttaaagttgacatagtttggatatttgtcccggcccaaacctcatgttgaattgtaacccccaatgcaggaagtggggcctggtgggagttgtttggatcatgggggtggatccctcatggcttggtgctgtcttcgagacagtgagtgagtcattgtgagatctccttgtaaagtgtgttgcagggctaggcatggtggctcatgcctgtaatcctagtccgttgggaggctgaggcgggtggattgctgagctcagaagtctgagaccagcctgggcaacatggtgaacatggtgaaaccctgtctctaatttgaaaaaaaaaaaaaaaaaaaattagccgggtgtgatggcatgcacacctgtggtcccagctacttgggaggctgaggcaagagaatcgcttgaacccaggaagcagagactgcagtgagctgagatcgtgccactgcactccagcctgggtgagagtgagattctgtctccaaaatagtaataataaataacaataataataagataaacatgtgttgcacctctcccccactctctcttgctcctgcttttgccatgtgatgtgcctgcttctacttcgctttctgccatgaataaaagctccctgaggcctccccagaagcccagtgatgtcagcatcatgcttgtacagcctgcagaactgtcagccaattaaatctccttagaaattacccagtcttgggtatttctttgcagcaaacaagaacagcctaatacaaaagtgttgcttagttctgagctcatcaaacatatatttaatagatatctctgccatgtgattatgtaagtcttggtttcaagtacacttaactcagggttttaaaatttctcttagcagtggaaatctcatcttaaaaaatattatgaacatttctaatttataaaatctaaaaaagcagaacttgtgtggtggaagaagggagggccagacagtgagctcagcagtcctattactagctcctcagacctcccctggaatattcaggaggacctgatccatctctagggaaccttggggcactgaggaacacagtttgtacaacagaacacatattctatttttcatccactctacatagaatggcagggcagaaagggacattcttagaggtctgattctttctaaacaattaatagttctgaaaaatagctttgaaattttttctagataactggttctctcttctgagtgcctgacttgttctcagttcctggaaatttcaaaatgagtggtgacatttatcagtggcatatgttgaggccatgtccagatcattccatctttaattcctcttgctgtctactgacatccggcttcctctgcattttcacttatctgtgtaactaaagagctaagctatgattctaaagatgatgcttgtgtgacaactctccacaagtactatttcaaatctgaatatatatattcttacaacccaggcagcaaatagtgataagttccaatgcaataaaagatgcaatgctgtgagaataagtaacccttcttttttgtgaccctgagttgcatttccaggagttgtagactttgtacccatccagacacactttgttttcttttcttttttttttttttgagacagagtttcgcttttgtcacccaggctggagtgcaatggcgcgatctcagctcattgcaacctcgacttactgggttcaagcaattctcctgcctcagcctcccgagtagctgggattacgggcgcccgccaccatgcccggctaatttttgtctttttagtagagatggggttttaccatgttggccaggctggtctcaaactcctgacctcaggagatccgccccctcagcctcccaaagttacaggcataagccactgcgcctggcccagacacactttctcatccaattcttccccttctccaacacctccctactcctcaactcccaaataacctcctggagttgtctgtagccaagaattaggacaaatccaggtgacccatgtcagtcctgctggtctcttcccccagtgtttactgccttttctaactagttgcccacagaatatagaatgaagatatggaaaagaagatgaagataattatgcttatttaaaacagcaagaaagacctcaaagtctgtaatttataaatatggcattttcagttcatagtttatcgttggtatgtcaccacttaatcttttgttataggacatattttagaaggttttgagattggaatcactataattaactgaaaactgtaaatcaataggataggcgagcttacagtatcactaatggagccttgtggttcattcatttttaaagggatcaacctgattatgattgaacctcctcttcaatgagggctcttatgcatgctggccaggatctgacacatgatgttccaactcatgattctatttcagttgtgatatattaaatgtctgagcataagagaggaccactggtctggtcaattttgagatttagccgcacagggtgaggacacaaatatttgatcaagtgtgaataaaagtccattatctccttagctagcaggtctagctcagcctttccttggcagagtccctgattcccttcacccaagcacctaacaaaaccagacaaacctgacaatcattaacattctcatccagctttgcccaactacttcctacaatcccatctagatttccaaagctggggctatctctgacccaatttttgaggccctttgaggatttcacaggtaaaggactttacactatttaacttaagtaatcctgatatataaaaatttatataaatttataaaaagaataaattaagaaacagtaatgctccttataaaatgtttcaaataggtcttctataaatagcaagttcctctgcatttaaaatactattctgggccaggcgcggtggctcacgcctgtaatcccagcacttgggaaggctcatgtgggtagctcacttgagcccaggagttcatgaccagcctgggcaacatagtaaaatcctgtctttaccaaaaaatacaaaaattagtcgggtgtggagccgcgcacctgtagttccaactactcgggaggctgaggtgggaggactgcctgaccccaggaggttgaggctacagttaaccacgattgtgccactgcactccagcctgggcgacagagaccctgtctcaacaaacaaaacaacaaaaaacccaaacaacaacaacaacaagaaaaacacgctaaaatactattctttttttttttcttaagatgcggtcttgctttgttgcccaggctggaatgcagtggtgcagacatagctcattgctgtcctgaatttctgggctcaaaggatcctcctgcctcatcctcctgagtagctgggactacaggtgtgcaccaccatgcccagctaattaaaaaaaaaaattgtatgtggcgggtgtcaccaccttgcccaggttgtctggaactcctgggctcaagcgatcttcctgcctcagcctcccaaagtgttaggattacaggcgtgagccaccatgcccagcttattctgttttttataaaatgttcacaaaaaccttttccatgaacacagatacttggtaaacctgtttttaaaaaagttttctgacaagctaagttcatctagcccagctgcctgcagtggtaacctgctcattaaccctcactagctcatccccattccatttttcactttcccttctctttgacttgtgcttctgggatcatctcccaaataaactgtaccaaaatccttgtctcaggatctgtctttgagagacccaaactaagctaacttcctcttggcagacgtggcaacgtccatggctctggtggttagggtagggtgttggagctgccctgtctgcttcttcttttcctgccttttgatctgtttctgcatcccacgccttccatcctgttgtgcactagagtagttgcttccttttaattcaactgaggcactagttaaaaagactttgactctaccaatggtcatagatggtctttcaagggctgaacctggctgccaaatctacagtactatccatgtaccagtaacaactttcatcactcatgccactctcttccaccctggctaagagatatgaaccatcatacggttgaggccaggttcggacagatcagtgtctcaaaggctctcagaggacctttcgatcatctcatctaatcccctaatctcacatgttagaaaacggaggggcagagaggataagcatttgctcaacacgttgtcaaccagtgaataaaaaatcaggtctgcactcctcccatttaagctttttctgaacccaccacatttccttgcttgtttgcctcattacgcttgctcatcaatactttcattatttatttccagttgacccaagtcaatgagttatatgtaggcactcctctgccctccttaccctgccccattttgaggttgaaaatctatttcccaccacatttttcaacaaagtaaaacctaggcactaagtgatggacaggaggttgttgctgttcacttaaggctcttgcatgattaagctctccctggaatttgtgtgtgggtgcgagaggactgccagtttggtccattgtatcccaggaagataagcattcatagctcgtggcctgccgagctcaggagaagctcatctgccatccaaactctggggagccaaggctaggctgtttctcaattgatctaattgataatctgggttctgttttcaattgtgacactgggtccctgcctcagctttgctttctggttccacctaacatgtctcgctttcttgctttccttctttctctctctctctctctccctccctccctctgtcaatggagtctcgctctgttgccgaggctggagtgcagtggcacgatctcggctcactgcaacctctgcctcccgggttcaagcaattcttctgcctcagcctcctgagtagctgggactacaggcacgcaccaccactcctggctaatttttgtatttttagtcgagacagagtttcaccatattgactaggctggtctcgaactcctgaccttatgatccacccgcctcagcctcccaaagtgctgggattataggcatgagccatcccgcatggccagccttccttccttcctttttttttttttttttttttgacggagtcttgctccatcgcccaggctggagtgcagtgtagtggtgcaatcttggctcactgcaacctctaccttctgggttcaagcgattttcttgcctcagcctcccaagtagctgggactacaggtgcgaaccaccaccaggcctggctaattttttgtatttttagtagagatagggttttgtcatgttggccaggttggtctcgaactcctgggctcaagtgatctgcctgcttcggcatcccaaagtgctgggattacaggcgtgagccactgtgcccagccatcttgctctatttctcagggttctctgaactgagtccgctgcccagtggggccagtctcctcattcttttaacttctcattctttgtccaagcaagctacattgttttcctccctatgtaaaatgtcaaattggtatttattttccactgtatcaccttgattgtccttttgggtggatttattttgtgtcctcaacagattattaaggacaaaggcagtgacaagactacctcctggcatcatgtactacccacagctttttatgaactgagcacttgtgtcccctcccccaatccctccattcatttgttgaagcttgaatccctagtgtggctgtgtttggagacagggcctctaaggaagtaattaaggttaagcaaggtcttaagggtggggccctgatggataggattagtgcctcataagagacaccagagaactcattctctctcctcaagcgtgctgaggaaaggccatgtgtaaacatagtaagaaggaggctgcctgctagccagaaagagaaccctcaccagaaatcgatttggtgagaactctgatcttggacttctagcctccagaactgcaagaaaacaattttctgttatttgagccacccaggctatatagtattttgcaatggcagcccaagctaatacatgggtgttgattgaaaacatggcccctatgctgggcgctagagtggagtttcaagctgggcatgtgtacactgctcctgcatgaaaaggtaattaactttggttttgggttcaaaactaaatcttcctttattgctaccatttagtaattcccatcctttactctgttgtgacagcatcctcccaagtgtggacatcctcccaagctctgaaccacaaacaaatctcttaccttcttttctacactgccttctggcatcgtatcagatgccaagccttagagaatctgctgtctcaagacctcttatattaatatctcctgtcaccctttattaccctggcataggctcttgcctcttgcttgttcttctcatttccagtcttcatctggtatgcagaggaggaaagggaggctcagaagaaacacatgccaggttgcacaactgaccaataactagggttcaaacccagttcaattttgcccaaatccagcatactttccactagacctgtttagtactctttccatcttgctaaaatctacactgttctgctttgtactatggttatttgtgaagctgtcttatgcctattatcagtgtgtaagctctttgagggtaggctgtcttgatcttcctgatatcccaggcaatggctaagccagcgccttgcactgtgtaggcacttccagaataggtaatgactctaaagtgggagataatggtcacaatggtgatatagacatagcagcttaggagagagacagatttaaagaaagcctgtaggagaaggaagagatgattttgagttgggcttgaggtgatgaaggaatttggatagattgagaggaagggttggtgtgaggtgggcttcaatgtcatgggtttggagttgaatctgtggaaggaggctgctttggaaggggccctggcgtttctgcatcaggtctagttgtgcatagtgagcaagttacttaacttttttaagggctggttttctaacatataaagtgggaataatggagtgtcatttggaattaagagcagaataatgagataatacatgtgaaggacttagcacgttgtatcatctattattaataataaacacttaaaatgttagcaataggccaggtatggtggctcatgcctgtaatccagcactttgggaagccgaggtgggcagatcacctgaggtcaggagttcgagaccagcctggccaacatggtgaaaccctgtctctactaaaaataaaaaattagctgggcatggtggcaggcacctgtagtcccagctactggggaggctgaggcaggagaattgctggaacccaggaggcagaggttgcagtgagctgagagcactccactgcactccagcttgggtgacagagcaagattctgtctcaaaacaaacaaacaaacaaaaaacaatgttatcaatagtaagatagcctgaaagttcagatgtgtttctgtctagttctctgagtaaattattttatttacactcatagataatgacattgctgctgacaaaaaccaaaattatctaaaagcaccaatacattcataggaatacttggttactataattttccttacaaatggataccaggagcccctctatatattttacccttaccagggattctcatagtcaaaaatttcagaaaccaaactgttgggaagcaggatagtgctatacatattctgggtagagctaacttggctgaatcagagatctggattttgggaacaggctaacctggtgaaaatccctgctccacttccaggctgtgcttttaaggaatttggacatactccttatctttcagtactttgctttccttacctaaaaggaggataacattccttcaaggctgtaaatagagtgctgtgtgtaaagcactcggcacaacgcgtttgtgtgggggagacacagtatgtgcataagaattggtagatgatgatggtgatgtttatgaaaatccaatcatgaatagccggaggccactgttgtcaacgagtgatccctgtaacagcgacgttagctacactgagaacttacacatgcacattctcaggcccattgcagacctcctgaaacgagaactcgggaggcagggccaggcaattggcactttgcctgaagcactcacgttttgagaacacctgtcaggtaacagggaaccactgaaagtttttggacggtggaggaatgcgatataaatgactgttgattcactggcattaaagtgcctaactaccgactggcttccgaggttgccggaagaaacctgttggttgatccttagtgatctccaggttacaaaatgcgggttggtactaagggccccaaacacagtgctcacctaccgagcgcagccaggagcgcagcgccagacaattacaggagctgttttggatatggccgggcagcccagcgatgctcagcgaatcccacaactacaaccacaaccgtaccacacatttagcctgcaaaagcagagaaaggaaaagaaaaccgtgcagggaagccggaaacgagggacttaagggtctcctctctagggtgtgggagagtgggggatggggcgaatggggcgaggagggggcgaggatcgagggaggcccctcctccgctcggcaacaccgggttcgggtccctctagagccgggacgcggccggcgggacacacccttgccctgggagacgcgagggtccatggcctcttagtgtcggtccagctcagtttcgtgtcatttgttgttagcgcgaggtaggggcgtttccccaccccagctcctccccggggaaatcccagcccgcttcctccccgctcctgcagttttcgggagcgccgtgcggggtcgagcgcggaggccgcaccctgggcgccgggcgtcgtgtcgggaccgctgcccgcgctgcccgccggcgcggccattgttcgagccccacccctgatgaatattcacgccgcgcgggcgcctcggcccgcgccctacccggcagggctcggggtgtgagtgcgtttccgccggtttttcctgcctgaggaggaaagggggagctgttttctctctcctcagaatatatttttggtgtcccgtttctcctcctccagcgccgccgccgccccctccctccccacctcgctccccgcctccgcctccgcctcccgggttatctttgtctcgctgcctcgcgctcactcgctcaactcggcgccgccgcggccccacgctccgggcccgtcctcgaggcgcgcggcgcggggcgcgggcgccggggcctgaggcggcgggcgacgcccgggggcctgacggccggccccgcgccatggtgtgagcgccgccgcccgtgcacgctccgtccgccctccgcgcggcccggccggcagagagccccgagcggcccgagagcgcagccgagcccgccgccgccgcccgcggccccgcgaggagagtaccgggccggctcggctgccgcgcgaggagcgcggtcggcggcctggtctgcggctgagatacacagagcgacagagacatttattgttatttgttttttggtggcaaaaagggaaaatggcgaacgactcccctgcaaaaagtctggtggacatcgacctctcctccctgcgggtgagtgggcccgcgagcgggcgcgcggggagcgggcagccggcagccggcagccggggccgcgcccaggtcggccgggcgctcgggcgccgccgtgggcagagccgcggggcgcggcggcccctttgtcttcctgtgcgggctggtgcggggcgggcgctaccctctaccgcccccacgccccgagcccgccgcgcgacccccgggcgctgggggaccgcgcggggcgaagcccacctcttttgtcaccgccttttctctccaactgccttgcttgatttattcatttttttggcttcttttaaatgataacccctcccctccttcctctccaggatcctgctgggatttttgagctggtggaagtggttggaaatggcacctatggacaagtctataaggtcggtgtgggcgccttctttgtttcccgtggcatgtggaaacttcttattgggggacgaggagagggtgataaacatgctgctgactggaggccacgccgcttggccaaagttgggagaggggtttctttcgccttgcagtccctctgtttttgcacaccgagtttatattcagactggccttaaaagacctcatttcctggctttgagataaggaaataagctacactcttaggcatgcactttacttcgataaaatggaaaagcattttttaaaaataagacaacctgaattttttctttttttccccaaatccggccttctgagtttgtgtgtaaattgaaatacagtggaggcgggccttgcctctgacgatcctaaaccactgctttggccatcgtgaaaattgtcatcatgtttcagcctccactcagtgcttgccagttgctcaaggtggggagtttggcgttacctgggaatactttataactgtggttgtcatcctttctattgatggatacgtattttggggaagcagggaggagtgtgtgtttgggcaacagcagcaggaagaattacagtgtggggattataaaatctgaattccaggaataacctgtttgacagctgtgtaattgaaacagaaatgacagagagcgaagagaatatagaggatgccctggtttacacccacccaggtctttctcttttttcaaaattttaacacccaccctccaccccagcgataaatgaaactagcaaatctggagactgagtctgcgctgagtagctgacacctgatgtgactaacagtgttcattttatacattgtacagtctagagattatgaaagatgtgtagggaatggaggcgcaggccttgaaaattcagaacggaatgttaaatttttcctgtcttaatttgtttctcaatactgaacgttttctaaaagtttaatctgcactgggggagtgttctgttagagtcggtacaaggttagggaagcagggctctgtggttcaccatgaagaattgtcattgtctcattaaaaatgggtggagttgggggggttggaagccgactgtagaccttttcttaggctagattaagtgtggatcttattgtctcttttctgcgttgtgagtagagtttatctatcacttgaacgcctctccttagcctagacttctagcctgggtagtgtactgtactggactgtggtccgaacttgggtcagtattcttaggtgatctcaagtgtattagcttgtgttttgttggttaactgttcgggccggggccagatttttgaatttgaaagagagccccgttaactcagcttgcccggctcaactgaatttggaaggctttggaaaattttggaaaagattgtgttgcaactcactgagtggttggtaactggctaaaagacattctccccggtctgttgtttgtttaagcaccagtcattttttttctaacccagttttttctcgccaaattaaatggtgattgtagtcttccaagtgaattagccagagcttgtttttgacctggctacacagtagttggattgtttgtgtcttacttggtcagcatggatgttaagggcagagaagtaagctagaaggcgatatagtctttaaaccttaagagaaaggaaagaatgaaaccccagtttgtctttattggttttaagaggtgggagctgtttatggtaagagtttagtcaggttcattgttatttcccctcattgccattttggttccattccccgcaaccttcccgagcttttgaactaggtttgctgagcgctagctacgtttggtaggtatttgggatactggcatgacacagctctctgactacaaagtcggtacagttgagaatttctctaattatgcaaacctagggaattaaatctgtgcaaaagttgcctacagtccagaacaaaatagtgcctgagattttgctcataagcagttacatttttatattattatggaaaatttcaaacataaagactagagagctcagtttatcagcagatgactaatcttttctcatctgtattcttcttttcctcctttattttaatgtaaaccccaaatgctatttcagctgtaaatactttagaatgtttcttttttacacaatcacattgttgttatcacacttagaaaaatgtcatatattcactattaacgttttcttgattgtctcatacatcagtaaaatgtgtttttttttttttttactataacaagttctttaatgtttacaagcgggtactgggaacttcaatcttagaagtggtgaaaatagcagaacatctctttttttcctctttttaactatttaatttctagaaccatttacaattatgtgtaggagttaatttaggatttttgttggtatgatttgcttgtggtagatttgggattacattattaacactttagagtttgtttattgctgctaaacatcctttaggatgaatagcattaaagtttgagaaatacttgttgctgaattgttatttataaaaaggtctttatttttaaacataatttcaggtaaaaaaaatctgtaagctgaacaacttgtcctaatttattttagtgtcatattttctatttttcattagcgcagatgttgcttattttgaggcaactatatttacatgaagtgagtgagttgaaaagagggagttttctgagatttgatatgtcgtatgaaatagcttcttttggggcgaacgactctcctgcaaaactgtgctaatggtagacccctcatttatggaagaaagggagggggaggggtgtgtgtggcagtagggctaagagtgacctttgggaatggtagaaaggttagggagtagtgggaatttcaaggagatgttatttggacttgaggagagacatcttctttaagcattgaggagccactgaaaggttttgttggaattggggatccctgagagtaggggacttgatccagttttttggggataacttctaattttctgtgtctctgacaacagtggtaaatggtctggtatagttgaacagtatgtaacttcatcttaaaagaaggaggtgaaaaacggggtgtattctgtttagagaaatttattttcacccttaggtttttgagagacggatactcataaacttaaaattgtaaatttctcttcacaaggttacattcagagtaccatatatttataagagaagtgtctggtatgatcagtgaggagaatgatagtgtgaaaaattaaaaccagaaataaatcaagtttgtttccatgttattttggattttattgttattttgttttgagacggaggtttgctctgttgcccaggctggagtgcagtggcaccatctctactcactgtaacctccgtctcccgggttcaagtgattctcctgcctcagcctcctgagtagttgggattacaagtgcgtgccatcacgtccagctaatttttgtatatagagatgggttttcaccatgttggctaggctggtcttgaactcctggcctcaagtgatctgcacgccttggcctcccaaaatgctgggattgtatacaggcatgagccactgcacccggccttattgttattttaaatatttatttgaccatttttgtgttcttggggtaactactgttattttgcattttgtgagcatgtgatggctggtgttccaaatgtcttgaataaaagattgtcaaccggacgcggtggcttacgcttgtaaatcccagcactttgagaggcgcaggtgggcggatcacttgaggtcaggagttcgagaccagcctggccaacatggtgaaaccccgtttctactaaaaataccgaaaaattagccgggtgtagtggggggtgcctgtaatcccggctactcaggaggctgagacaggagagtcacttgaacctgggaagtgaaagttgcagtgagccgagattgtgccattgcactccagcctgggcaacaagagtgaaactctgtctcaaaaaaaagaaaagaaaagaagattgccagcctgaggacaattctgagtcttggaaggactgacagaggggaaatccggtaacagtaacgtggaagtcagggagtttagaatccagcaggtaaaatgtctgaaatcaaggttcactcaaaggagggaccatagattttgtggaagactgacccattctgatcttgtcattggaggaagggtacaatgtggaccttggagattgaggacaagggtaccctaggcccaaagaccttgatggtaaggggagctaacgctaagagtttgctcattcgatgcccatttgacactgtgctcatgttagacccctcatttattgaagaaagggaggggagaggtgaggtgtttgtgtgtggcagtagggctaagagtgacctttgggaatggtagaaaggttagggagtagtgggaatttcaaggaggtattatttggacttgaggagagacatcttctttaagcattgaggagtcactgaaagattttgttggaattggggatcccttagagtaggggacttgatccagatgtgtgttgggaaggagctggtaaaatggttggccttgggcagtggtccagtgacaggaggtgaaggccgaggcgggatagtggcagtggtggtagagaggaggagaggttggggtggatacttgggcattactctttgctaggtttaacatgttgaattcactcgttctctgcaggctttggtatgtccctttaagtgggtacacggtttgcccacagtattaggaggagctttgggattcccagcactttgggaggctgagacgggcggatcacctgaggtcaggagttggagaccagcctagccaacatggcaaaaccccatctctactaaaaatataaaaagtagccaggcgtggtggtgtacgcctgtaatcccagccacttgggaggctgaggtgggagaatcgcttgaacctaggaggtggaggttgcagagaactgagatcatggcactgcactccagcctgggcaacagaatgagactctgtctcaaaaaaaaaaaaaaaaaaaaaggcgggggtggggtggttaaagtgctaaaattgctttcgattgctcagtggtaaagtgccatatagattgtctggcttttaaaaatcattaggggccgggcacggtggctcacacctgtaatcccagcattttgggaggccgaggcgggtggataacaaagtcaggagttcaagaccagcctgtcaacatggtgaaaccccatctctactaaaaatagaaaaattagccgggcgtggtggcgcgtgcctctagtcccagctacccaggaggctgaggcagaagaattgcttgaacttccccaggaggtggaggttgaagtgagccgagatagcaccactgcactctagcctgggtgacagagccagactcctccaaaaagaaaaaataaaataaaaaaatttgcattttggagcaagtacttaaacttttgtgagggattctctaagtgttatcttttaagtgtagcatctctcgttcttaattggaggtaaagacatccactggggcaaaatgaattttgtagaaccagatgttttcattaggaggagattgtgtcagctgatctgccactgagaggcatgttcaggcttgttctgagacatagatttccttcatgtggaagattctggacttggacaaggtgggaggaagccagccctgttgagcaagccctgctctcaaagagtttcaacccttactttcaaaaactgttttactaactcaaacatcaaaagctctacagaaaagccaaccaccaaacaaaaccctgctgatgatgggtttttaactccttactgcttgaaactttgtgataaatgtacatttatttgcctagctgcaaactcaactcgtattttgccttttttcttaaccaatattttatgtgtgtgtgtgtgtgtgtgtatatatatatatatatatatatatatttttttttttttttttttttttgagatggtgtctcgctctgtcgcccaggctggagtgcagtggtgtgatctcggcccactgcaagctctgcctcccaggttcaagcgactctcctgagtagctgggactacaggtgcatgccaccaagcctggctaatttttgtatttttagtagagatggggtttcaccatattggccaggctggtctcgaactcgagtcagggtaaagtttttagacatacagggaaagatgactaggaagaaaatggagaaggccaaggtaatcttatatttattaccagtgaccattgtggcagcaatggttgttaggttttataatgttatatcactgctcaccaaacagaatttgttcttttgttatggagcaggttcagtaataagagttggtgagtattattcagaagagaagctgcctcttgggttgagtaattaataaagtgattcattgggaggtagtttttgtctgtaagaatctctaaggaatgatcacaatgataagttttaggacatcccgttttaaaaactggactcttacaaactttgttatctagatagcattaggtataactaaattggggagacaaaagtgaaaaacgattaaccatataagggtggtttcatgcaggtactgtggatgtgtgctgggccctgttctgagagttagatacacagtggtaaatgaagccgatgatatatctacccttatggaactcaagaaaaacagggggatggacacaaaatgccagctgtgggatgtcagtcatacattctgtgttgtctgcatctccctgggttccctgcccagcacacttgtgttcagacacaatgaatgcactgacacatggaaacagcacatactgcaatgtgttcattttaagtggctcaacctcatcagcagggcttctctgtgctttaaattacagtaaaaacaaatgaaaagtgaaatgaaaaggtagacatatagaatatcagtctactttttttactcgtagaatcaaaagacattttcccatgtcaaattgctgtaaaagtttttgtttttgttttctttttaaaaaagtataagaaactcaggtgatataaaagtttttatatacttttaatttcagaaatgatcttgctgtggtcagcagaccacactttgaggaacactgaactggcaggattgaatttgtagcagggctcttagtaaactgtgggtggttggtgtgttagtgagctggagaattgaggactgttgtttgtgcctagtatttggttctcccaccctttgaacattggggagctacagcaggtgctgcttacagctttatgctttagtgccaaaacgtctttgacccctgtgctttggaactgtctcagatatggctaaatatgaacaagttatcctattaaatttaaataaatgaaagaaaaaccccacttttacattataactttaaaaaatccttcatatgataaatagggccttaacttaccagttatgaatcgatagttataatcaaatgatactaaagcgctcataccaaaagtcagagtcatcctgttctccagaagcatgttttcagtgcttttagctgctacatctgaaatttattgctatatttgtaaattatgtacttatgtggctagttcatttatcagttttatacatttattgacgtcctctagcagtagttgtagttattgaactagttagttcaatagtagttgaatatttaactcctatacttgctgcctcccttaagtgggcataccataattttgggttaaagtgatagttgtttcttttatcatgactatgtaaataccatttatatgtgagctaaacagtctcatacgattacatttccttttttaaacaacacccctgcccccacatcgcttttagtttttcatttgcttagttttctttgtacctatcatcaccttcctcctcagataccctaaaaggtataacaaatgcctaacaaagtttagtctttatcacattttccaaatgcttaatttaacaccacacgtcagataatttattgttgcaagataacctgttgatttcaattttttctccctggagtttcctcatagctatgcaggtatggttgcccctggacctggcatgtagctattattgtcctggaatgtctgtttcctggatactgcagtcttcctttttggtttactatcttactttcctgaagcacatcctctagtagttttaaaagaaagggtatatgggtattaaggttttaagtccttgtatggctgaaaatccctttttcttatcactgcctcatcttctcttgtctggaacataactgctttcgatttctttagggactaaatctctggtttcctgtgggtatggagtgatgtgaggcagttaccagactgtgtaaggcagagaaaggggacctggggctttcaaccactaaatatgcaaactttcatcagttctgattttggccttgcacctcacttggtattggtttattccaaatgatgaccttgtcagggttttgtaggtccaactgtctcacttctttttggtatcctttagtaggcacttaggttgtaatttttacctcttagttactactccatccactttttattttatcttttttttttttttttttgagacagtctcactgttgcttaggctggagtgcagtggcgccatcttggcttactgtagcctccgccttgtgggtacaagcaattctcttgcctcagcctcccaagtagctgggactgcaggtgcggaccaccatgctcggctaatatttgtacgtttagtagaaatggggtttgactatgttggccaggctgttatcgaactcctgacctcaggtgatccccctgcctgggcctctcaaagtgctgggattacaggcatgaaccactgcccctggtctgcctgtctgtctgtgtcttttgagacagagttttgctctgtcccccaggctgcagtacagtggtgtgatcacagctcactgcagcctcaacctcctgggctcaagcaaacttcccacatcagcctcttgaatagctgggactacaggtgtgcaccaccatgtccagctaagttttttttttttgtttttttttttttttgagacggagtctcgctttgtcgcccaggctggagtgcagtggtgcaatctcggctcactgcaagttctgcctcccgggttcacgccattctcctgcctcagcttcccggttagatgggactataggtgtctgccaccacgcctggctaattttttttttttttttgtatttttagtagagatggggtttcaccgtgttagccaggatagtctcttatctcctgacctggtgatccgcccacctcggcctctctaagtgctgggattacaggtgtgagccatcgcgcccagcccacgtccagctaatttttaaaatttttagtagagatggtatttgaccatcttgcccaggttactggactaaagtggtctgcctacctcggcctctgaccatccactttttagctgtcaaaacctgatagaaatgatctctactacctcttttcccctttatatctttattcttttgtttactttaaaatcatttttatgggaattaattcttaataactcatgtgatcagtccaccatgtttaaccaaaagttgtgtctttgattttggacttagggttttgctcaggtgtttgtttcttttcatccagaacaataacaataccaacagaacaataacaataccaatgaaacaataacaataacaacaaataaaaaatgaaaacaagggtaagcagtgcgtaacctctgtgaccttactgtgtgacctctgtcagagatacttaatttgggaggtgcaagccgagggagatgaggatgaggaataaggaaagtgaggcaggatgccaagcagtgccatggtacgtattaattaccatgctggctgctgctttgaacaaacctttgagagatagaggagtttgttcagcagtattttttttttaaagcagctttattgaagtatgttttctgtattatgaaattaacccaattcaagcttacatttcagtgatatttagtaaatttactgagtggcacaaccatcaccacaaatcaatattggaacactttgatcatgccagttagattcctcgtagtgatttacagttaatccctgttccaacccagagccccaggcaaccaataatctgccagtattaatttgccttttttgaacatttcatttaaatggaatcctacaacgtatggtcgcctgtgtttaatgtttttgaggttcgaccatgtagcagtgtggttctttgttcctttttattgctgaattttaggctatggttgtaccacatttgttacctgttcaccaattgataggcatgatgttgatggaactgcaccttaagtcatccacagaagggagaaaggagggggaatttatctgtttgggtcttcttgtttccctttagtgtaaccaaacacttggttctgatgaccctgagtgactgtctggatgagggaaaagcagttgaagttttgtgtccctgaatcctttatcttccccagtcttattattagtcattactgtgagtttatttatttatattttgagatggagcctcactctgtcgcccaggctggagtgcagtggcacaatcttggctcactgcagcctccacctcctgggttcaagtgattctcctgcttcagactcccaagtagctgagattacaagtgtgagctaccacgcccagctaatttttgcatttttagtagagatggggtttcgccctgttggcaaggctagtctcgaactcctcacctcaggtgatctgcccgcctcggcctcccaaagtgctgggattacaggcgtgagccactgtgcctggctttaagtcatttttaaaaacaagaatacagtttctttcttatcgctatgaagacaaactattcactatcagcgaggtcactggtagtaggaactaggccaaactagtttttccttctatttttgggaggaattcccttgtataatagccagctatttaccatgtgatgctagactgcagttttcctttatctcaagcagaagctattgtcttgcctggattttgaaaaaacaaagcaaaatatgttatctttggtcagaaggatgtatcccaagttaaataaatgatttgctatgtgttttgggcgaataagtttgctcatttgtttcaagtgtatttttcagagtatttttcttatattttattcttaagtttttttgtgataccttttgttagggccttactgcattcagattacataaaattaagttaagtaatagtttattttttgaaaattcttatactgcagagctttcgttcttacttgctgtgacagtgacagaatactgttgactaccagagcccttctccccctgagtttttctgagactctttatgtgtaattggtgtgtagttttatgacttcaattttgagaggtatgtcaaagactgaatattatctgagttagggctgtgcatcaaggtacttaataatttgttggagatcccggttgaatattgcctgaggttgagtgtgtacatttaagtgacacaattcactgggtgtattcattcacctgctagggcatgactcagattctagggccattccagtttgaacttggcatattagagcatcttagttctctatatgtacacattttctcatttattcttgttgccttccttgattcccagaaaaatctgacaggtgttcagctctttactcttcagtgatttcaaggcttggtttctgtttcttgtttcactgtctacagatattttgagcctactctgctagtcaagatttcctttatttatttatctagtacttaatgtgtttataatatgtgccaggcaccatgcgaggcttgctcactggtgacaatggacaagaaaggcagtcagcttatgcccttgtgtagcgtatagcctaatgtgtaaggcagaaaatgaacacacagttaaagaggatgatattgcagatggggaatagcaggggcctatgggagtgtgtgacatgacagctaagttagagctgataaaacagatacggtggtatgcacagtgaagctttatgatttcaattcagatgctctagatgaggcatagatatatgtggagcagtgaacagtctgctaggagttaaaacccactgagctgatgattcatcatcttggttaatactactttgaataaagataggaggggtgtgttccattgattatggtaattgactgtcttcattcagtttgccttgagccagctgtctctcaggaagccttgcctcctacatctgcactgtttggtgctccttgcatttgaatctcctgtatcagttagaagttagcatcctgaacattctcatatgggtgaaggaggggccttcgtcaggcttcagattgtcttatgagcaatatctggaataatatttggtaaacagctggcctgaagtaggccacattctgccctacattacacatggggagactgctttgttcagctgctggtccccacgacgttagggctgaaagggacctctgtaaaatgggaacaatggtgtacaggtttgtgatattcacatagtttttaataagtttctgtagttccggttatataacaaaataattaaaagataaagtttttttgcttttttttttaagacagagctgcaacctctgcctccagggttcaagcaattctcctgcctcagcctgtcatgtagctgggattacaggcatgcagcaccatgcctggctaatttttgtatttttagtagagatgggttttcaccgtgttgatgaggctggtctccaaatcctgacctcaagtgatctacctgccttggcctcccaaagtgctgggattacaggcgtgagccattgggcctggccttgctctttgataatatggacaaaagagaattttatttttctaatccgattaggtaaaatgatgttgtggtttttttttgatgttgagtgagatatttctaaccattctctaatcatactggaaaatgggactttgtagtcccattagtatgctggctttcaaagtgtgaaattctttttgcattattttgtataagcaagggctttgtcagtcatcaactccaagattgtattagacgtttcattagttttctagttaattagctgaaaatatattcttattgttatatgaaaaaagcaacttaaatgttgaattttaaataggatgcttatttatttttttcttgtctttatactgtttattttcttgctggctctatcagctaaggacttgatctcattggtagtctgtcttgccctttttttttttttttttgctttttaatgattccttttgctgacttattacctataacttctacttaggttgttttataggttgctttaggtttgtagcacatgtttttaacttaccacagtctaccttcaaatgatattataccttactatggtatacctccatttctacccacttggccttatagttttttagtatacatttcacttttatttattatttatttatttttatttttttgagatggagtgtcgctctgtcactcaggctggagtacagtggtgcgatctcggctcactgcaacctctgcctcccgggttcaagtgattctcctgcctcagcctcccgagtagctgggactacaggcgcaggccaccatgcccggcgaattttttgtatttttagtagagacggggtttcaccgtgttagccaggatggtcttgatctcctgacctcgtgatctgcctgccttggcctcccaaagtgctgggattataggcgtgagccactgtgcctggccctattttttattttatttttttttgagacagtatctccctctgtcacccaggctggagtgcagtagcatgatcttggctcactgcaacctccatctcccaggttcaagtgattcttgtgcctcaacctcctgagtagctgggattacaggtgtgtaccaccatgcctggctaatttatttttagtagagatggattttcaccatgttggccaggctggtctcaaactcctgatctcaggtgatacacccatctcggcctctccacgtgcagggattacaggtgtgagccactgcgccaggccgagaaatttgtttgttgaggaatatcaaagatcctggccttggaacattgatagttcactttgaacttcaagggttgattaattaaaagtttctgttaaaccaaaatctttttttttttttttttgagacagagtctcactctgtcacccaagttggagtgcagtgggcaccatcttggctcactgcaacctccacctcccagattcaggcagttctcgtgcctcagcctcctgagtagctggaattacaggtacctgccaccacaccttggctaatttttgtatttttagtagagacggggtttcatcatgttggccagactgatctcaaactcctgacctcaggtgatccacccacctcctcggcctcccaaagtgctgggattacaggtgtgaaccactgcgcctggccttaaaccaaaatcttgattgtgcttaaaatatttaagtaaaaaggtactttgctatgccagtgttccagtttgacagtgatcaattaaaaaatttttaatccctctgctgagtgcagtggctcattcctgtagtcccagcactttgggaggcttaggtgggcggatcttttgaggtcaggagttcaagaccaggctggccaaatggtgaaactcatctctactaaaagtacaaaaaaaatgagctgggcacggtggcgcatgcctgtaatcccagctacttgggaggctgaggcatgagaattgcttgaactcaggaggcagaggttgcagtgagctgagatcacgccactgcactccagcctggggtgacagagtgagaccttgtctaaaaaaaaaaaaaaaaatgctgggtgcgatggctcaggcctgtaatcccagcactttgggaggctggggcaggtggattgcttgaggtcaggaattcaagactagcctcaccagcatggcgaaaccccgtctctactaaaaatacaaaaattagatgggcatggtgggtgtgcctgtaatcccagctacttgggaggctgaggcaggagaattgctggaacccgggagacggaggtagcagtgagctgaggtcgcgccactgcactccagcctgggtgacagagcgagactccatctcaaaaaaaaaattttctaatttcccatcatctgatcctaccaaaaataacaaatacctagggggtttttcatttcatttacaatctggaacctcatatggccttatgacaagagccaatattttaatatctttgtcttagaacctcactcatacaatagagacaaacctcaaatccaatccagagagcattgcttcaaggaacagtggtgacttaagataggttggaagtctaatggtgctgcggaatgctaaacaatcaagccttttcaggtttagtttaatagttgttattcttatactttcaaaaccattttcatgtaatttttttcaactatttattaaatgttagtaaaagaggaactacctgaacacagattttgtccaagcaacctgtttagaataaattatagggaaggaagttttcgctaaaatgcatttcctgtacttgtgaagaaacttgttgagaaattaactttgagaaagttatgccatctttatgcaacatatttatatagttaagaaacataattttcttacatttcaaaagaggctgtttgacaaaaacggctagaagacccctccctacacagtgagaaataacattctacaattatgttatataactaatcataataattttactttctccaaataactataagcaccttatcttccccgttatcaaaaaaccgtgagaaaatgagccttcctaagaagtttgacactgataccagccaactctaaatcaaaatggaaattaacattcctttctaaatcatgtgcagaattcatttgaacattctgataatttccctataaactctgatacgtaaatgttggggctaggaggaggcttgaagattatcttgttcaaactctctggtaaaagaatgtatctaagatttgttccataggctgcagtccacttcgggaatcatggaactcatcagtcacataaatggaactaagataccttctcatagttaaaaaaaccagcttaagaaattcttgccacccaacttttcttctatgaatctctcaataatttttcactattcagagaatgtggtaaaaataagaggcttcaagacccaaaagaacaaatgtatgggaactccatacctgcattagtctgttagggctgccataacaaaaggtcacaggctgggggcttcagtaatataagtcattttctcatagttctagaggacagaagtccaagattgaggtgttggcagagttggtttttcctgaggctcctttttctaatttgcaaatggccaccttcttagccttgccttttgtgcacccctccctggtgtctgtgtccagatttcttcttacaaggacagcagtcagattggattaaggttcactctaacagccttattttaattcagtcacttcttcaaaaggccttgtttctaagtctcaatcactttctgaggtactggagatgagagtttcaacatgtcagtaatttttgggggatcacggtttcagcccataacaatactgtaaagtttttcttgtactgaagacacagaaaataactttactctaaagtgctaatgatttattaactaacacaggtagaatatcccttatctgaaatgcttgggaccagaagtagttcagatttttttggattttggaatgttcatattatatttcatggtataatatctctaatccaaaagtctgaaatccaaaatgctccagtgaacatttagtttgagagtcatgttgatgctcaaatggtttaaaattttggattagggatactcaacctgaaaattttgaaccttgtttttttaaactaaaaaatacatagggtcttctaatccaggggtccccgacttctgagtttcagacaagtactggtccttgacctaataggagccagtccccacagcaggaggtaagcagtgggaaagcaattgaagctttatctgtatttatagccgctccccattggttgcattactgcctgagctccacctcctgtcagatcagtggtggcattagattctcaaaggagcatgaaccccattgtgaactgtgcatatgaaggatctaggttgtacactctttctgaggatctaatgcctgatgatctgtcactgtctcccaccactgccaccccctgcctaccttcatggaaaaagtttcttcatgaaactggtccctgtgccaaaaagattgggactgctgttctaatcagataaatagcatattcattagtatattcattcaacacaaaaatactacagatggccgtggctcacgcctgtaatcccaacactttgggaggccgaggtgggcggatcacgaggtcaggagattgagaccatcctggctaacacggtgaaacgccgtctctactaaaaatacaaaaaattagccgggcgtggtggcaggtgcctgtagtcccagctacttgggaggctgaggcagaagaatggcgtgaacctgggaggcagagcttgcggtgagccaagattgtgtcattgcactccagcctgggcgacagagcgagactctgtctcaaaacaaaaacagaaacaaacaaaaaaaactacagatgctattttagatgatggagataaaggatggcaaaaaaaaaaaaagatacagttcgtgttttcatggggtttaaagaaggcagtaaacccatcagatggtggtactatatcagttagcctttgctgggtagcaaaccatgcctgaaacttgctggcttcgtgttgtataagcatcatcatctttgttcatacttttgtaggtcagtaatttggactggggcatactcagtgtggtagtgtggtggctcttctatccatctcttctaggatctctccggaagctgaagtcagctggcagttaactgggggctgcatggtgtgacttgggttggccgactttttaagcaccctggccttttgtttcccatatctcagttttctttttgtctcctttcttccttttgttgttcactaaggaatatttaaaaagtttcgagtattataaaacattcaacttttggggaatgagatggagatataataaatggagataaatatgtacatttaatatcttcattttacaaaagaatctaatcaccattaattacagtgttacagtatgccctgttacagctgagagttagggttttgcatccactaatttgggtagggtgacaatagcaaaatgataaataagtcatgaatttagcctgggcttttggtgctcaaataccttaattcatggatggcaacaccaacactctacctgcttttcttagctcaacaggaaatgagagtagggcttgggcaggaggaagtcatgcatacccagctgtcagcgtgcggccttctcattggttgtttaggagagcaaacgaagcttatctccttccccaaattgttgataatgaaggcgaaaagagatatagctacaggtaaactagattgaatctgctgtttatgtgttggaagatgacgtttgaagatgagttttagttcttagcaccaatacaacaaatgatgggatttgaggtttaagtgcctaagtttaaggctctcatataataactcttaatttctttttgtgtcgggaaaagaacaaactcttgccttgaattaaccagttattttaaaaaatcatagacttctgtcattagaggaaacggcctgaactccattaccaggtgactttttagctttagtgggtggcacatgggactgtctgtggtgtgccatctgcagtgcgcaagccatttgtttctggaaacagtctcacaagcaatgattctggtgagtttagaaatgaatcaggatgtgctaagctcaatgaggactcattagccttggataatgtgattctataaatgaacagaatggagacggtgaagactcaggagtatagagaaaataggatgacactggaagctaggctgattggtgggagttttggaatcaatgtgcttcaactattagttgattaagcatatagttgaattagtaaagagtgggagacttgccccttgactgtgtgttattaaaaaaaaaaaagctatcttggccaggcatggtggcttatgcctgtaatcccagcactttgggaggccaaggtgggcagatcacctgaggtcaggagttcgagaccagcctgaccaacatggagaaaccccatctctactaaaaatacaaaattagccgggcatgatggcacatgcctgtaatcccagctactagggaggctgaggcaggagaatcacttgaacctgggaggcagaggttgcggtgagccaagatcgcgccattgcactccagcctgggcaacatgagctagactccgtctcaaaaaaaaaaaaaaaagctatcttgagtactgacatggtccaccatctcctttatgtacatttcctcaccttaatttttattttgcatgtgcatggagaggttaagtaacttgcctaaagacacatagctaggaagcaattggagaaaccaagtgttaaggcatttcagtcctgacttctaagtttagctcttaacctttttgccagattt

SEQ ID NO: 503 - DNA, 19934 bp, Homo sapiens
tacataagtctacatatttcttcataacacttggtatctttggcctaaccaacctctatatgagcagagataataaatccaatacaaaatcaaacttgtgcaattgtgcaattaagtaaaaaaacaaaaacaaaaacaaaactagtttctggtaatacggggatacaccatcctcaagaaaaagttgagcatctcaacaagttacttaataactactataatgcctatgtagcagcactggttttcacatgttttaaattaatacatatccgaatctcaacttccaagcgtatgaaataaaacctaaacagtgaattgatacaaaatatggcaagtgtgttcaatccctaaatccagagccaattaagtatataagatcttaaagaagactattaacccaatcctgtctgcaaactgggggatgagtgcagctaaggacagagtcaaaaggaggtatttcacccagcagcaaggtgggtgggcattgtctccagcaccataaccagaggctggtcactgtgcttttatctctggccctagatacagaagacacagaaggagagctgtagttttcttatctattttccagcctctgggctatctttgcttctagtagcctttcatgggcagagtcctacacatcaacgatatgaagccaaagcttagtgctgggaggaggaggtgttaagccatgaagcatcaagatggaaaacctgctttggaatattattgaaatcctagtccgtgtcacacccaacctccttgtgctggtgggaatttttgtttgtttgtttgtttgtttgagacagagtcttgctctaggctggagtgcagtgcagtggcatgatctgagctcattgcagcctctgcctcccgggttcaagcaattctcatgtctcagcctctggagtagctgagattacaggcatgtgccaccatgcccagctaatttttttatttttagtagagacagggttttcaccatgttggacaggctggccttgaactcctgacctcaggtgatccacccacctcagcctcccaaagtactgggattgcaggcgtgagccactgcacccagcccttgctggtgggaatttcaacacaattggcagaaagcagagaggggagagataaacattccaccaggtgaaggctttctggaatagcctgcccacacacagcgcaagatgtcccagataaaatctgagcgcccagcccagtttcaaaacttcagccacaggagtaccatgaacaggcgtggatctactgctcaaagaaatagcctcctcactcacaccagtctttaaaatgactattaaataaatcattttgaatctatttgtcaaactgcggcttccctaaaccctaagcagtgaaactcaagatttgcttgtagaaattgaggctaacacgtggtcttcttctggtccccaaatgagactgaaacacttaaagacttacaatcagtcataaaaagagatatattatcatctcacctagaaaaggatcatctaaaaggaggtgaagaaaaactatgggtgcatgggtgagggttttaattaaaatactcaagctttcattaatggccaagggataaaacctaaagttgattagacacctgcatgtatcagcacagcactaggagctttacagagctcattttatttaagtcctattttagaacaaaggaaacagtcttaggcaaggcaaactcacagttggctactcaatgtcttttatttctgcctgttttttggccccagaaaatgcaatattttgacacagaaaaaaacattaggatgagtgtgaaatcaaatacgattctggtttttgagctgacatttagtcatttggagccacatggctgtcccagggcctggtccccaggtcatgtgcttaaagcttccaggcggttctcatcatgatgatgaagtacacatcagtgtcaatggatgcgctcacacctgcatagtagttcatgaactcctcaggggtcacctgcagtggaaaagttagaaacaaaaacgaaactttgcttctcactctgtcaatgggcgcccaccttgtgcacctgtaaatagaagggaaatagaggatttctttgtgtatgtgatcatggctgaggaactgatctaaaacaaaagaacaagtgaagctgaggatggtgtgagaacagcacctaggaagagagaaagaaagtcttgaaagtttctaagccaacctaaatggaaagtgacgcataggttgtcatcttttgtctaagggtgggagcccgtcggttcaggtaagggagactgaaactcagagtaagaaggaagtgctctgcaactgtagttatttctgtctttctgtgacacgtcagaaacaacatgtcatgtccttgtgtcagggtaagtgatgttttccctttccaaaaatggagttctctcctgtgggtgaagaaacagatttctagttaaacgctcccgggttgcatgcttttctaacacataaataactcattcaaggcccagggtgaataaaaagcttacccctgcttcatgcctcccacccatcctggcttctctccactctacacccatgaccatctctttgaaatattgactaatgtgtttatctgtgtggggattttatattactttcctttggggaaggagaaaagacagttattagtcttatttttaacaggtctagataatatgtacactctaatttaatcatgttggttgacatgatcggttggggacatacctatgccttccaagaatcataagagatgactgacccactggtcctattgaaattataagtgaccagaaaagaaaagtcactggatccacagttgtctttcataccaccccttcccactaaaaacataaggaagggcagtagaaagaaaggcatttgaactcagctcatagttgaactgtaaatacacatctacaatacatgcatagagcctctgtcaaaattaggataccattagcatccccctttgttgaacttctttattcctctcctcctttggattcctcagcctctgcttttcaattccctcattaagggattacattaagtttcacacatcattattgccctctttctatctttctcatgttgtgtgaggttccagggaaatgtttatcagtgtgggtccacaccacctgcatcaggacaacctggggtgtctgtcataagcctaggcccacaggctgtaccccacacctgctaaatcagaatctctgaagcaggtggttgtggaatttacttcttaaaaatctaaacatcccagttaattgttgtgcacactacagtaatttaactgggaatatcaaagataattaagataaagtctcagtcctcaaaaagttgcaggctggtgaaatactccaacaaagtaagtggatcattttacagcaaatagcaagtaaactaaaagagttacccacgagaccctgagccattttgacggtgcactttaccatgacagtttgaggaacattttttacagctaattattttttaattaaaaattatcaaactcccgatatttttagtttgttattgtttctattgtctgtttgttggccagggatgacagccattgaatgagactccctccacatccactgtaataatcctatccctagcttttctctcccacagaagttgaaaaactcaaaactcactttcccagactcctctgcagcttcagcttgggatggccaagtaatagagttctcaccaataagatacaaaggaaatttgacatgaatttctagggaagcctttgctttcctgatgcaggctccagccctttctcgttccctccttctccctcctttgtcctgctgcctgaaactcagatgtgctggctgaagttaggcaaccatcttgagatcatgaaggaaaggccaggaaaatcacaaagacttcagctctgctctctttaagccactcaagtgagaacatcaagtagaataaaaaataaaacctaatttgtgtattccagtgtataataagatttcctatttcttgcaattgaaagcaaaccctaactgaaacaccaatacatgattgagactggtatcgtcacccatccttccatcccaaactcccccagtgggatggggtgacctgagttgagttggctctgttggagaatggagaaggaatccaagatgggcaaaagataaaggaagcattaaacctcacttggaagtcagatgacgtcaagccagaggtcagagctaatgtatttgatcatttcagaaaaagccatcagttactcttagctaggtgtttgcttgttttctgagactcaacttatattgggaatggcctgaatcgcaaattctctgatctcctgtaaatttgccctcatcatagtaaattgttggttagcaataatcactatccttattcattttatttgacattagaaaaaaatgagagactgggcactcctacttttagcaggcctcttgactaggctacctttatgtgacaagatatatatcatatatacaaggaaaggtcccagatgggggtaatggaagtcacaatacaagccctttttctcagctccaaattcatcagaaaaatcctaaaacaaatctaggttactattaatacatacactcagtaatatacctaacatatttttaattatttaaaaattttttatgagatggatgaggcaatagactgatattccctgaaggtctaaagtcctaagaggctttttaaaaatatagtgatgataaagtcatatatacacatgaagaattcaaaacttagatattaaagaataagaagtaaatgtctcaccaaattgtggtggggtttagtgatagaaaaggggtaaggaaagtctgtgtcacaggttatctgattgcttcacacctccatccaaatggcttccggctgctatgggagtccagtgaggtattagtgcaagatttatgacatcaaattccgtgactgctgaaactccagcaacctttatgggtatttgagagtttaacctagattatcaagtttgaacattacctttagctaggagctatgctaaattttttgcattattttaaattttgtcttatatgggatgtttttaaccataaatgagcacactggcttcaagtacagctatgcttcaccacaagcaatcttaatatgcaaaatagtgcaatttgcaagaggtaaattttagaagctaattattcttctcataaaagaatttaccatggagttcctctacaacaacaatttcttgtgcatttaaaatacaattcagtgtgcgaaagtttgaattacacatcacttttcagaaacacttttattatgtctattaaatgagatatccctggtaagcccttagcaaatgcccagttgatatgtgctcaaaaagtgttgcccagattcattattatgctaaatggggtcatgtgtatattatatttagtaattttaaaacagttatttctgaatcttttagagctaaggatcacaaatacacgtgagtgtaagagtcatctggtacacattaaaatgtaaagccttggactccatcctccaaaaaatcagattctgtggttctgcagtgcagctaggaatctacattactaataaatcctccctgatgatgattatgaacagccagagttgggtatcaatacagggtctgtaacatgcagatgacatcaagtgctataactgctaaaaacctcaataacctttatgagcttttgagagcttaatgtggcttcttaagataaatatcaaaaggggtgatgtgcagacttgaatcagccgaatcacaactggctattttgacttttgttagagaaaagggtagctgaggtttcccctggcaatgaggaggaaccacctgcagagaggaagcagacacactctaggatccacaaaggggtgggctaatttggggaaatggcagttggctatttttccactgacatctcagtgatcaaggccagcaatactggaagaaaacatgtagtttttatttctgtccctaagattttggctgccctattgaattttggcccttttgtaaacctgcctccacaatcctcagcctgaaatagagggtatgtctccatccctgaaagggaaatgtcagcaggaagaacagaaaggtcaccttcctatcccccaccccttgctaatgagactcatcatgaagtttcatttaaaaagttggagcacattcccttcagaagaggaaggtttatttcttcttcccttaaccactctcttcttgtccactgggccacttatcttttcctgtgctgtaaagggcttaagagacaatgaaccctggggctgtgctgctgctgactgttactcaagggacaatcccctttccttatcaccaaaacccttagatcatctaagaacagaactggctcagggttttttttttttttctaaaaagtcaatttagggctgttgataaaggacagatgacattttcatctcagcctagacacagtcatggagctatataattccttaccctaccaagctatgcatttgtaacttgaagataaaagttaatggagatgggcggttgattttgttttcaaattcagtgcagtttagaaatgtaagttaatctcaaagcacactaaagaataaatcagagtaaattctgttatttgacattccctttaccaaaaactacctttaaatggcatttccacatagcaaagtgtgaagatgaatgaggatgagtgtgaaggcactaaaacatcctgaaaggccttgtaaatctgttctccaaaattaaattatgatctcatttcaaagttaaatatattttattataatcagttcactggagtgcaactagctgagtatggtaaatatagtaaccataaaatggcatgtttaatcagaacatcacattccccagatgacaggtcatcacttatgtggatcccctaccaatatatttcaatatatgtctatgagtgtgtgcgtgcacaaacatacattaggtttcaactaaagtaacatgaaggtttcccctggcaatggagaagtttctagattgttcctagggaaatagtttacttctatttacaacaaatatggtatcaatgtgttaacatttttaagagtttggacctatttcccatttacaatttcgaattgaagaaatttcccctagattaggctcttttacttaccaatccatctttgtcatagggtgaatcaaagttatccagaaatttcctaaatacttgttcctcactccattccccattctggtactttgggtggtgttttgcattatatacttcacgaaggtcttcgattgttataacaccatctccagtcttgtctaactttctaaaagcttgcatgattacctcttttctggctctggacattggaggctacaaaaatagaagaatacatacagagacatacataagcaaatgagcttttttggtatcctatgtgataaaatatctcattcccctcaacgatgtgaaataatatttgtgtgctattatgtaatagacactacaattgctccaaaaattcctaagtctgttcacagttttctgcttatccccctccccacagtgtactaacaacttgtaaaaacaaaacctcaaggtagccaacccaaaccacgtgaaagccaaactcagcagatacactgattaatggggccacttactcttaatgtgagaagaaattcattgaagtctattgttccatttccatctttatcaaacctccggaaaagttcttccacctcttctttttccatgaccacagcataatcatttaaccctttcataaattctttaaaatcaagggttcgattattatcgtcatccataattctaaacactctgaagaaaatacacacaaaaattcagaagaaatgtacaaataacaggtgtaagtgtaaagattaaaaaaaaatccacactcaaggtttcgtcaaattaaaatacaaaagtcttaaattcttctctgcaccctcctttccaaaactggagagcctcttcccaccacacacacacaaacacacacacaaagtataattctaattacatgacattctgcaaaagacaaaactgtggagacagtaaaaagatgaaaggtaaaggaaagagttgaattggtgaaacatgggatttttaggtcaaagaaactatcctttataatactatgatggtggatacatgacattatgcatttgctaaaacccatagcactttacagagcaaggtgtaaaccttaatgcatatcaattttaaaaaaatgatttaggaagtcagaaaatcacagtgatgtggctatgttagggatataggagccaacttaaatagctctcaagatcaaggctggaacaattaaaccaataaaactatgctggattataacccaaaatataaaaaagaaatccctacatccatactggttaaataaatgatagagtaaataaagatgaagaaaatgacaaatttctcttgcagaaaaattccaaataagttatggatatattctcctctcaaggagggaacatatactccccactctctaagtgtgggctctacaaagaggtttccttccaaaaagtacgatatggaaaagggaaaagggaagcaactttacaatggagaagtctgacaaatactacctcaatcaggtgatcagtgtcaacatcaacagtaataaatcatgttaatcatacatatccttggtataatgtgataaaaatggtgctttatgtctgtggtccctaaaaataataagcccagtttagtcatgaagaaaaaaatcagagaaattccaataggtgggcatcctacaaaatacttgacctctcacattcatcaaaaaccaggaaagtctgagaaactgtcataaccaacaggatcctaaggaaacattacaagtaaatgtaaagcagagttctggatgagatcttgaaacagaaaaggacactaggtaaaaactacggaagtatgaataaattatgggccttagttaataatcatgtgctggcattggtttttaaagtagtctatttaaaaaataagggggtggagcaagatggccaaataggaacagctccagtctacagctcccagcgtgagcgatgcagaagacaggtgatttctgcatttccaactaaggtaccaggttcatcttactggggagtgtcggacagtgggtgcagcacaccaagcatgagctgaagcagggcaaggcatcgcctcacccaggaagcgcaaggggtcagggaattccctttcctagtcaaagaaaggggtgacagacggcacctggaaaatcgggtcagtcccaccctaatactatgcttttccaacagtcttagcaaacggcgcaccaggagattatatcctgcacctggctcggaggatccgacacccaccgggcctcactcattgccagcacagcagtctgagaccaaactgcaaagcagcagcgaggctgggggagggatgcccaccattgctgaggcttgagacggtaaacaaagcagccaggaagctcaaactgggtggagctcactgcagctcaaggaggcctgcctgcctctgtagactccacctctgggggcagggcatagccaaacaaaaggcagcagaaacctctgcagatttaaatgtccctgtctgacaactttgaagagagtaatggttctcccagcatgcagcttgagatctgataatggacagactgcctcctcaagtgggtccctgacccccgagtagcctaactgggaggcaccccccagtaggggcagactgacacctcacacggccaggtactcctctgagacaaaacttccagaggaacaatcaggcagcaacatttgctgttcaccaatatctgctgttctgcagcctccactgctgatacccaggcaaacagggtctggagtggacctccagcaaactccaacagacctgcagctgaggttcctgactgttagaaggaaaactaacaaacagataggacatccacaccaaaacctcatctgtatgtcaccatcatcaaagaccaaaggtagataaaaccacaaagatggggaaaaaacagagcagaaaaactggaaactctaaaaagcagagtgcctctcctcctccaaaggagcacagctcctcaccagcaatggaacaaagctggatggagatgactttaacaagttgacagaagaagactgcagatgatcaaactacttgagctaaaggaggaagtttgcacccatggcaaagaagttaaaaaccttgaaaaaaaaattagatgaacgtctaactagaaaaccactgcagagaagtccttaaaggacctgacggagctgaaaaccatgacaagagaactacgtgatgaatgcacaagcctcagtagccaattcgatcaactggaagaaagggtatcagtgatggaagatcaaatgaatgaaatgaagtgagaagagaagtttagagataaaagaacaaaaagaaatgaacaacgcctccaagaaatatgggactatgtgaaaagaccaaatctatgtctgattggtgtacctgaaagtgatggggagaaaggaaccaagttggaaaacactcagcaggatattttccaggagaacttccccaatctagcaaggcaggccaacattcaaattcaggaaatacagagaatgccacaaagatagtcctcgagaagagcaactccaagacacataattgtcagattcaccaaagtggaaataaggaaaaaatgttaagggcagccacagagaaaggtcaggttacccacaaagggaagcccatcagactaacagcggatctctcagcagaaactctacaagccagaagagagtgggggccaatattcaacattctaaaagaaaagaattttcaacacagaatttcgtatccagccaaactaagcttcataagtgaaggagaaataaaaatcctttacagacaagcaaatgctgagagattttgtcaccaccaggcctgccctaaaagagctcctgaaggaagcactaaatgtggaaaggaacaaccggtaccagccactgcaaaaacatgcctaattgtaaagaccatcgatgctatgaagaaacggcataaactaatgagcaaaataaccagctaacatcataatgacaggatcaaattcaaagataacaatattaacctgaaatgtaaatgggctaaatgctccagttaaaagacacagactgggaaattggataaacagtcaagacccatcagtgtgctgtattcaggaaacccatctcaaatgcagagacacacacaggctcacaataaagggatggaggaagatctaccaagcaaatggaaaacaaaaaaaggcaggggttgcaatcctagtctctgataaaacagactttaaaacaacaaagataaaaagagacaaagaaggccattacataatggtaaagggatcaattcaacaagaagagctaactatcctaaatatatatgcacccaatacaagagcacgcagattcataaagcaagtccttagaaacctacaaagagacttagactcccacacaataataatgggagactttaccaccccactgtcaacattagacagatcaacgagacagaaagttaacaaagatatccaggaattgaactaagttctgcaccaagcggacctaatagacatctacagaactctccaccccaaatcaacagaatatacattcttttcagcaccacaccacacctattccaaaattgaccacataattggaagtaaaacactcctcagcaaatgtaaaagaacagaaattataacaaactgtctctcagaccacagtgcaatcaaactagaactcaggattaagaaactcactcaaaacctctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgtccacaagagaaagcaggaaagatctaaaattgacaccctaatgtcacaattaaaagaactagagaagcaagagcaaacatattcaaaagctagcagaaggcaagaaataactaagatcagagcagaactcaaggaaatagagacacaaaaaactcttcaaaaaatcattaaatccaggagctggttatttgaaaagatcaacaaaattgatagaactctagcaagactaataaagaagaaaagagagaagaatcaaatagacacaataaaaaatgataaaggggatatcaccaccgatcccacagaaatacaaactaccatcagagaatactataaacacttctatgcaaataaactagaaaatctagaagaaatggataaattcctcaacacacacaccctcccaagactaaactaggaagaagttgaatctctgaatagaccaataacagaccctgaaattgaggcaataattaatagcttaccaaccaaaaacagtccaggaccagaaggattcacagccaaattctaccagaggtacaaggaggaactggtaccattccttctgaaactattccagtcaatagaaaaagaggcaatcctccctaatttattttaggaggccagcatcatcctgataccacagccggacagagacacaaccaaaaaagagaattttagaccaatatccctggtgaacatcaatgcaaaaatcctcaataaaatactggcaaaccaaatccagcagtacatcaagaagcttatccaccatgatcaagtgggcttcatccctgggatgcaaggctggttcaacatacgcaaatcaataaatgtaatccagcatataaacagaaccaacgacaaaaaccacatgattatctcaatagatgcagaaaaggcctttgacaaaattcaacaacccttcatgctaaaaactctcaacaaattaggtattgatgggacgttatctcaaaataataagagctatctatgacaaacccacagccagtatcacactgaatcggcaaaaaactggaagcattccatttgaaaactggcacaagacagggatgccctctctcaccactcctattcaacatagtgttggaagttgtggccagagcaatcagacaggagcaggaaacaaatggtattcaattaggaaaagaggaagtcaaattgtccctgtttgcagatgacatgattgtatatctagaaaaccccatcgtctcagcccaaaatcttcttaagctgataagcaacttcagcaaagtctcaggatacaaaatcaatgtgcaaaaatcgcaagcattcttaaacacaaataacagacaaacagagaggcaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcttgaaaatggccatactgcccaaggtaatttatagattcaatgccatccccatcaagctaccaacgactttcttcacagaattggaaaaaactactttaaagttcatatggaaccaaaaaaagagcccacattgccaagacaatcctaagacaaaagaaaaagctggaggcataacgctacctgacttcaaactatactacaaggctacagtaaccaaaacagcatggtactggtaccaaaacagagatatagaccaatggaacagaacagagccctcagaaataatgccacatatctacaactatctgatctttgacaaacctgacaaaaacaagtaatggggaaaggattgcctatttaataaatggtgctgggaaaactggcttagccatatgtagaaagctgaaactggatcccttccttacaccttacacaaaaattaattcaagatggattaaagacttacatgttagacctaaaaccataaaaaccgtagaagaaaacctaggcaataccattcaggacataggcatgggcaaggacttcatgtctaaaacaccaaaagcaatggcgacaaaagccaaaatggacaaatggcatctaattaaactaaagagcttctgcacagccaaagtaactaccatcagagtgaagaggcaacctacagaaggggagaaaatttttgcaacctactcatctgacaaagggctaatatccagaatctacaatgaactcaaacaaatttacaagaaaaaaacacacaaccccatcaaaaagtgggcaaaggatatgaacaggcacttctcaaaagaagacatttatgcagccaaaagacatatgaaaaaatgctcatcatcactggccatcagagaaatgcaaatcaaaaccacaatgacataccatctcacaccagttagaatgacgatcattaaaaagtcaggaaacaacaggtgctggagagaatgtggagaaataggaacacttttacactgttggtgggactgtaaactagttcaaccattgtggaagtcagtgtggcaattcctcagggatctagaactagaaatatcacttgacccagccatcccattactggttatatacccaaaggattataaatcatgctgctctaaagacacatacacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactattgcaaggacaaaaaaccaaacaccgcatgttcgcactcataggtgggaattgaacaatgagaacacatggacacaggaaggggaacatcacacaccggtgcctgttgtggggtgaagggagggggaagtgatagcattagaagatatacctaatgctaaatgaccagttaatgggtgcagcacaccaacatggcacatgtatacatatgtaacaaacctgcgcgttgtgcacgtgtatcctaaaacttaaagtataataataataaaattttaaaaaaaagcttatcgtcattagagaaatgcaaatcatgtcagttagaatggtgatcattaaaaagtcaggaaacagcagatgctggagaggatgtggagaaataggaatgcttttaccctgttggtagaagtgtgaattagttcaaccattgtgaaagacagagtggcatttcctcaaggatggagaaccacaaataccatttgaccccacaatcccattaccggatatatacctaaaggattatagatctttctactgtaaagacacttgcacacatatgtttattgcagctctattcacaacaacaaaaacttggaaccaactcaaatgtccatcaatgatagactggataaagaaaatgtggcacacatacaccatggaatatcaggctgccataaaaaaaggatgagttcatgtcctttgcagggatatgggtgaagctggaaaccataattcttagcaaagtaacacaggaacagaaaactaaacatcgcatgatctcactcgtaagtgggagttcaacaatgagattacgtggacacaaggaggggaacatcacacagtggaacatgaacttcagggggtggagggctaggggagggataacattaggagaaatacctaatgtagatgacaggatgatgggtgcagcaaaccaccatggcacatgtatacctatgtaacaaacctgcacgttctgcccatgtatcccagcacttaaagaataatttttttaaaagatggaaagttggagtaatcagaatctaaagacttttaaatgtccttaaatgctaaaaatttgaactttattagcaagtcatttttaaagtcattaaatggttgacttgaagtgacattatcaaaataatgagaactttacccataagagagctaacagaactctagcaataatgggttgaatgaattggaggactgaaaacttaggagcaaaggaaccagcaagaatactatcataagagtccagtgaaaaaaatgttgagtgtctacacttgagcaattgggatgaaaataagaaaaataaagatttcaagatattatagaaataaaggagtcaatatggtgggctaatgaagataattctaaagttttcaacccaaagacctggaagagtagtaatactgttaaaaccgtaggggctgcagaagaagctctatttggaaaacaaaaaacaaaaaaaatgacttttgttttgtttggattggatactaagtcaactatatagagatattcactggttagctagtatctttcctgattaaaaaaaaaaatatatatatatatatatataaaaattgtgaaattagtttggatctcaggaacggatagcattccaagaacgtggcaaggggccaaggtacagatgtgctaactcaggagtagccaagttgtctgataaattaaggatactagcaaaagaatcttgagaatttagatactagagaagtatctacatttacaaggcaattggaaatgactaagaaagaacgtatactgttgaaaaccacaagaatttcatgtcaaaaaatgaaggtgccaaggttataaataacaaagtcatcttgatcttggtcaggataaagactcagggtggaaagatggtgccgggagtcaatgcttcacagaatgctaaatgttgtgcaggggggatgatggcagagcctaacctgaagagatgcccttctaagacaggatttatgggaaagaaataaatgaacaaaggggtgtgtatgacctgggatttggagttagactgaaggagagtgttcagtcttcaactgaccctaaggtaggagtggaggagaggggcagcttccacttgagttaggagttacttagagaaggccaaggccagtaagtgaggcagatggcacattctgcaaaaggcttaggatggaacggtgtccattgactgtagactggttcccagtggaaaggctggtagagacgcagtgtgcagtgggtatggggtgaagatggcacaggtagcaggagggattccactgagtgaaccagagagtggaagagaggattcctcaagggtttgcactaaggacaatgatgtggacccatgatgaatgggatagaggtggaagtgacacaatattgagggcatgggtgctggtcttcccattggactggggcagcctggccaccagggtccatatccccactgcctggccttctgacagagctgggcttagtctgagacttgggactgttcagagttttctcccaggcactcagtaccttgctggaagtgaagccttccgcatcttctgggtccaaggctagatttccctcccattggcaccctgtacttctctaataaacaacttctcacaccactgagatgccatttagatcactcatattgtccatagtcttagtcctccatgggggcttaagaagccttgttcacccacgggtccctgagatgtgtccaatgcctggcccatggcaggctcttgatggagtttcttataatgcacaggacctgccctcaggaggctcacaatctcctttcccttttggtttctcagtccttaaaactattcacactcagaggacagagggtgggagaacaggagctacccagctgagagaaccccattggcagtgagctatcagttatctgacaagcaataccagtgtccctggaagtgatggagaaatgattgcccgagagcaaaattccaaattctgcaattagggctaactggctgttccttcctccctcttccaccctggcctttattatcacagctgcagagagagtccctctcattgtcctggtaggcatctccatgccagggcacatgctgcttctccctttacctcatattttcccagagctgcactgtcttgtagcagatatgagtcttgccgaatctgggactaagatccaaaaactgtcacaagggacctcatagatcaactcttctaaactctacattttacaaataaggaactgagcccctaggaggagatgacttccccaagaccacgtggccaacattagcctcacctggcagagtcattccttcccgctccattccctgccacttgtagctgggtcctacctgccaagtcctttgatcccagcagagcccctggccaggcactgcagtcggagtctttcaatggggtcggtggccgtggtgagctttttcttggcctggatcgccatctctcggtcatggcgcgctgtccctgccatctgaggggaagccatagcatgttagcaaagtccaggcctcgccgctgcctctggctgggcagagtgacagaagcctcactgagaaggaaatttacagccttctctgtcaggaaacctctcagaatttccaatttttctctatgccaactgtgtgcctggcatatttataacttacttatctagtcctgaggacatctggtttctccagcctagacaataatcttaaatatatcaccatttcccaagatgttttgatctttctgaagccctcttccatccataaaagaagtgcaatttctctatactctcttttttgaaccaacattatataccatattattttatgtagaattttccatattcccttgaccctcacatttaatgttctcctctttggtctaaacattgattttgttgcttctgtcttgaatgagattttcagcacttgatccttaatgattcttaccagtaatgggtatggtctccttgattcacaggttagtatccactaacacctaatgaggttcttaggatgggtgcagtgaagtgctgtctcctgagtggtccccaagggacgtacaaactcttgtagccacacttgagctctcaaagcttgcacaacagtgggaagagcacttagctgggggcctggagacctgggttatagtcctgactcttcaatccccacccctcaactcccccaacccctcacccccatctgcctggtaacctgcctgtgagtgaatctcacagcctgtttcctcctcttttaactgggaggattggataagatggtctttaaattccatcccagcttcaaaaaacactaattctcataagtccacatattcagtaaatgggggattctggaagttacctgtgagtcgtgaatgaaaagaatgagaggcaagaggctcgaaggatgtgcaaaggacagcatgcaatgtgcagaaaaaaaaaaaaaaacggtattagaatgtggttccaccctggcttcgaggctccctccccagtcaaattctggcacttcccctaagtgctacattaggactgaattattttcatcaaagacagcaacctgcagattcacaacctcgtctatgccaagagtgttgttctcctatacaccctgaaaggtctcccatagagggtactccttatttgacttttgggaaagggaatctcatcaagccaataactgaggccagaatagacaattcagggatgcatacacttaacgtggccactttcttgcagcctccaccgagccaaggtacaggatccctctttcttgccctgtattcagattcccagtatgtggatgaaggtgggagcaattcctttcagttctcttgaacctcgggtcaagaaggagacctgtctacgtcccagctctttactccacattaggaaaaacttgctctgtctaaagctacacagtcttcctctgcttccactg

SEQ ID NO: 504 - DNA, 72754 bp, Homo sapiens
gaaaaatttaaacaatattatatactaaataattttgaaacaatattatacactaaataagatatatgtatgtgtatatatatatatatgcatatatgtatagttgacccttgaacaacacagtggtaagagtgccaagccttcatgcagtcaaatttgcatataacttttgatttccccaaaacctaactactaatagccaactgttaactggaagccttaccaataacataaacagtcaatcatcatgtatctgtatgatatatgtattataaaccatatccttacaacaaactaggttagagaaaacatcattaggaaaattaattaaaaaaagagaaaatggtttacaatactgtactatattttttgataccataagtttaccttgtctgtttacaagatgcaacttccgtctgaaatggtaggcaaccacagccgcagacctcaatctatgtcacgtatcagacaatttagctttttcttgtaatgtcgtgacttttctctggttcttgggatcacttccagcatcactagtggcacttcctatgggtctcacggtgttattcaaggttcgcggtattgtaccaaacatgatgaaaaatacacaagaactgcgagagattactttttactgtgatacacaatttactggagagacgagctgctaacgtagagatgattagagacacactgcatttaaagtggatactcacaacacgagctcaccgcagtagcaataggaggtggctatgaaattattacggtagtatagcatgtactatagtcaattttatacagttatgatttaatactgcatcattgcatccacttaacttgactgcaaatggcaacatgtaatgtctgtgtttgtgtttaataacacttaactttttacaatagatttgtacgtattttacagcagaaaatgataaaatagactaatatttaatatatcatgcattcatgacattccttacatttttaaatttttttatttttatttctgggctgtgtggttcatctatcagttgttttaaattactgcaaatattttaaaaattttaatatatttattgaaaaaaatctgtgtgtaagtagacctaggcagtttaaatccatgttgttcaaggagtaactgtatacacacacaaatattcatatataaccagggaatatataacatatgtattatcaatacatagtatataacattataacatctaatacacacagatatgcacgtatctcagcttttgtaaagttaaaaactatttgggagaaaatacatttgttttattctttaaaactaaacacatttttgatgtgtcaaagagttgaatatggaaataaaacctcaagatgatgaaaaaatatggaagaaaattttgaatatcaagatgaggaaagatttgtaagcatcaaaaaacaacaacaaaaacaacaaaaagaagtcacaacataaaaaatttaaatttctgttcattgaaaataataccataattcaaattaaaagcaagtattggagtgaaaacatatttttcaaattaacagcagaaagtgtttaagatatttaatatataaaagccttataaagtcacaagatatgtgttgtgtgtgaattatcaaatttattaaaatataaatgtaaaccaccaagtatatggaaaacttatttgccatcactagtaattcacacttataccttatgaaaacaagatattttcatttctcaaattgttacagtttattttattttattttattttattatactttaggttttagggtacatgtgcacaatgtgcaggtttgttatatatgtatacatgtgccatgttggtgtactgcacccattaactcgtcatttagcattaggtatatctcctaatgctagccctcccccctcgccccaccccacaacagtccctggagtgtgatgttccccttcctgtgtctatgtgttcttattgttcaattcccacctatgagtcagaacgtgcggtgtttggttttttgtccttgtgatagtttgctgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgttaatagtgctgcaataaacatacgtgtgcatgtgtctttatagcagcatgatttatagtcctttgggtatatacccagtaaagggatggctgggtcaaatggtatttctagttctagatccctgaggaatcaccacactgacttccacaatggttgaactagtttacagtcccaccaacagtgttatttttataattatcagtgtcagaatgagttgaaatgagcgtgttcaaacacagccagtggaattatgaattcatccatttttaaaaaaagcaaactgcattgaaagtcttaacagggttcctacatctactcaacttctgtttctttttcataaagaaatggagatggatacatttcagttcaagatgatatgttgcaaagtaacataaaatattaaaaagtaaaaacatccaagtattttgcaattattggatttttaaaataatgccacatctgtagaacaactatcaaaaccatacacttggagaacatttagcaacatgggttggagtgttttcaatataatgcagatgaaaaatctcaattatatccacttgttatgagttcaagataggctgggttaagttatagtaaaaaaaaatctcaaatttaatgacttaaacaaaattttatttatcattctcattacctgtataaagtgggtcaacaaagggtatctgctcatagtagtcacttgtggtccgagactcacagaggattcatctcaacaaacagatgtttccataatcaccatggcaggaggaaggaaacatgaggaatcactatctggttcttactacacttctgttcatatttcactgtttatatttcatggtcacatcttctttggagtgtatggagaaatccaataatattatgcatatatatctttgaagagctttgtgctcctcaaatttaaaaactatatttagaaaaaaatctttgatagtattgttctaatgctgtatggtgggtttataagtattaattttataattgtgctatatttatgttatgttatatatgtgagataacatatatatatatatctcacctatatcagatatcacatataaaaaataaagtaaaaatgggaaagtaatcacagcattaaatcaagaagatggggtgttaaaggcagccattctgtatactaaaactttctgagttattttataaaacataatttgaaaattaaagttatcagattataattcagtacttaactgtattaattcagtacttaactgaattgtttgaataaaactgaagaaaaaaggttttttttctcttgtataaagtaatggattcaatcaaaaaagaaatttatttgtctcttctttatttaacttaaacattgtgatctctgtgataaaattacataggatgtagagcttacagttcgattttcaaatgttaaaattcagatctttaaggtaactcctatcaatgcaacatgactaaaacacttgaaatcacatcctttattggataaaatggtatatatgtgtacatacatacatggataatcatacatccaaatgtgtgtattctatgcacccacatcaaccaaaatgcatgcactataatcagctaaaagataaataacactaaaatttcttctttctcaatagaaattatttattttcacaaacatgcttcccactggctgctaacaagtagagaatagggtttttttttgtttttaaaaaaaatgggtattgatttcattgacctgttctctagtcacacactaataattaataaagctgaagtcacttttttaaacagtgctattcagcctggtcttggtgtaactgcaaagatccactcagctcctttgttgtagtccatcttggccatagtttgtccttaactagctctctgtttcaagtaattaaatttttactttattttctgtaccacatgtcccactatcccattgtccctgagtcactcacttgactctctgcctaatatctcagtactctggatttgttatcccactttgctcttaattttttgcagaaacaaagatatagtccttggtcttcaaataccaaacctgaatctctagtattagttgctcgagccacataatattgattgtcattctacctgacctcactcattaatttatggatccattcaatcattcactcatttgacaaacatttacagatcacatataggccaggctctatgtgaggttttgaggacataataatagagaccaaccttgctcttctatagtagcaatggccatgaaatatataattatgataaaaatttaaagtactgtaataaaatataatccattattcttgtagatcaagaaggcagtgataaactctgattaaaaggattgtggaagatcttatgatagagctaacaatgcatctgggacttgaagaatgatttgaatttcacctcagcgtcatgaaaggaaagggcattccatggagtagaaataataacatttaaatgtgtggaaatataaaagctcttatgcatcaagatcctactgtagactgagatggagagagagcaatttttaaaaagggaaaaacaaaagctatgagaccaaatgacgagataaggtctgaattttttaagaagtgagaaaggtgattatttttaattaaactgttttacttgactttttcattttcttttggcaaactctgaaaaagaattattcatataagttcaggtttatgtgttattccaggagacttagattttttttaaaaaaatatgaaattcactgaaggagtttacaaagggagtaacatagtgattgatatatgttacttaagatcacattgacagccattcgatgtattagttaaaagcaagactaagcagagagcccaattagaagaatattacaatagttctgaaaaaaattagatcctgcatgaagctgagacagtggtaatagacaagataagtggttggggacaaattcaggaagtaaaaaggtaattgttctaatgggtggatttgttgggctatgtaagagagaatgggcaagggagacagcatgcttcatgactccccctaaggtcctagatttgataacaaaatggaattttggtgcaataatcatgagagaaaaatgtagaaggaggcagaggtcatcaaagtataaggtttgagcagagctaatgaagaattctgcacaggaaatggcggctaatgtatctgtagggcattgttttaggttatttcaaagcaatcgttactaatccattcacacggagcaaaggaaaaaaatgagccatattaacttctggactatttgaggggaggaagataaagaaagaaggaaaaagaaaagaaggtaccaattgctggttatctctctaatctcccagttattgcctcaagttggcataagttatctagtttctctttggggtcgatatggccagggtagactaggtttgagaaacaaataggtcattagcagaactgagagtgtaggctgaaggaaagcaagtaacctcactccagtgaagttccatcatctttttatcttttgtctaaatgactgttaagtctaattaactagcccagaccttccttctcagtaccagaacaatctatcgcaccatttaatttccatttattagaatgccatccatttatgatgatatgtccttgagacatgataaaagatcagctgtctccctgtgcatgaagaaatttctaagaaatattgttattatgtcaccttggggaaaagagaacttagggtcacataaaacattttggttttaatacgctgctttgagagaatgtgtactctttgagaaaattgaatataattgtgtactaatccacataaaaaattaagtatctaatgttagtcaaagtgagtctccataagcaaggcaaataaatctcactgataaaaaattctactacttagagtaggtcttaaaagaaaagaaatacatgaaaagtaaacctttttttctgtgttgtggtatgtggaagtaaaaaaaatccactgcttgaaaggtctacatgggaaacagtgtcctcaaggaaaaagttcatttcaattaatgttatacaatgaaagaaagattcacagaagtgtttaagaacagatggtcccaaatcaggtaatggggatagggttgtgaatattgcaacagagagggttggacggtctccaaggagcacatacaaatttctaggagtcccacctgactcctactagataattattactccaagtgagtctttgaatactcttttcctgctggtagttgggtggtcttactccaggtgcagggatttcctttgatttaaggaaatgtatgggtgaataacctagtatttcaaaatatcacttaggaaatttcatgaagctgactttcaatgatagcttgttgttcactaatacaaccacaactatgttaaataattctgtttttaaaatattttattgagatataattcacatactttttaaattatacaattcaatgatttttttggtataatgacagagttatgcaactatcacgacaattttagaacattttcatcatctcaaaaaaaattgtgtactcattagtagtcactctacatttcaccccagcccttgacatgtgctaatttgcttatctctatagatttttctgttttagacgtctcatataagtggaaccacataataaatagtcttgtgtgtctggtttcttgtacttaacattatgttttcttaaagtctgtctgcattgtagcatgtatcagcccttaattcattttttatggctaaataatgttccattatacagtgtattggttttcttgggctactataacagagtactacacaatgggtggcttaaaacaacagaaatttaacaattctatcctttgaaacatttttatactttgtacagcatgcctccctaacttaagttctctgactagacagaacacgatcccttgtcagttataacaatctactgtttatatggtttatttaaggataatcagacccatatgaatttatctgagatcccccagttgatacatgtaatgatgtagctttgttaactcaacaaaattgatttcagattccaggatgtaaagagtgttgacagtccactgggaaccaggtgacacaaaatataatgacagaatcagcaacagtagtgatcaggggctattccaagactacaagactgtaattattccattgtcactgaaaattgtgttttatatcacacttgatacaactgtcaataatgagtgagtaatagcatcctacatacatatttatggagccattttcctaagaatttcaactaagggaagcattattttcatcacctgtcaaaacaaaatagaacaattacaataagacattaaaatttttttatagtgataggcctaaaacatattcaagattcttggttttattcatctcacaaatatttagtgagtacttgttgtgtactgcacactgtgttaggctttgttagggaacaatactctcctccaagaactaacaacttagaaccgataaaagcattcaacttgaatatatctcaaaattctcctgctaccttgccagtcttgggtttatcatgctggctgtttagcttagttccgccttgcgtaatcaggccacatctgtgcagatgcagtaattaattcatatctgtggcctgccacaaggagacataaatattaatagagccttttatccataattttagagggtagcactttgggatttttgagcctaggaaagccataccagaaaaagagagcacaaggtcaggggtacaactggctggactagaaaatccatcaggtcagaataaaagaattaagaaacttatgtgtgttttagaatcaatcttctaaatgcccttcagaaaatccttctcaggacactactttatttaagcactgtattgatttcccccttatctttggtttaattccaaattattttatgcaactccaaagaccctgcttatttcatggggagggcctaactttacccctgagctagttttttttgctgttcaccctccctgaaacagtcttctctgtttcctcagttggataacttatcctatcttttaggtataaatgtcatcaacttcctctaataaatattccatgacaccctctccaccagggagtagattagacagctttttattcttttgcaaaagaatcctgtattttccctactctaaaatcatgctgtagtatgactgtctgcttatttttctgtaataaaggggttcatatactttattggccaaacaagtctattttgagattaaaaagagtattaaaataactataatcttatacaagtttaaaataagtatttactaacaagtggggtttgggcctatggaagtgttataaaatatttttgaaataaaatgtttctttaagaaagcaatatctatttctattcataaaagcaaaagaatatttgtattgattatcagcacattaaataacaagtagtatgattatttatgttatatattcatttaatttaaacaccatcttagttgtacaagtaatattggtcattattattctatttgtggacaatgtatttttgaaatacagttttattgttttccattttttcataaaattgcctgcatttgttttcaaagctgtgctttatgctaataaatttgaaattgttgaaaccttcaattgactggtctccatagaatacattacttttaactgagaaaataccctctctacatgcactgaagtacctagtaatcgcaaattattttttgctaaatacagcatattctcagataatggaaatatattgtatatttcaaaaaaagctagaggaaaataatttgcatgtcctcaccacaaaaaactgataaatatttgaggtgatgaaattctaatgactctgatttgatgattacacaatctctccatgtattgaaacgaacaatgttccccatacatatgtataatcattatgtatcacagctttttcttttaatattaaaatgtatacatattttagtcccactgttgttgttgttttttttttttttttttttttttttttttttgaggcagtgtctcgctctgtcacccaggctggagtgcagtggtgcgatctcagctcactgaaagtgtcgcctcctgggttcacgccattctcctgtctcagcctcccgagtagctgggactacaggcgccgccaatgcgcccggctaattttttgtatttttttttttttgagttgagacagggtttaaccgtggtctcgatctcctggcctcgtgatccgcccgcctcggcctcccaaagtgctgggattacaggcatgagccaccgcgcctggcctatttttttttttaaatgtattttattgtatatatttgaggtttacaacataatgttatggagtacatatagatacatcgtaggaaatataatggttctagagtgaagcagattagtatatctatcatctcacataacttgttttttgatgtgacaacagcagataaaatctacttaacaaatatccttaacacaattcaattttatttagtcttcatgttgtacattagatctttagatttgttcatcctacctatctgctattgtacatcttttgacctacatcttcctcatttcctctctccctctcccaccaatggtaaccactgtttccttctttatctctgtgtatttgagctcttttattattttatatttaatatataattgaaatcatgcaatatttttttctctgtgttgcttatttcacttagcatagggtcctcctggttcatgcatgttttgacaaatggtaggatctcctttttaaggctgtgtaatatttcattgtgtatatataccacattttctttatacctccatcaatgggcatttaggttctttccatatcttgactgctgcaaataatgctgcaatgaacatgggaatgccaatctttacaaggtggtgataatctccttttggtatattggtatatattcagaagaaggatttctgagtcatatggcagttatatttttagtatctctaagaccctacatatttcttcccataatggctagatcagtctatattcccatcaacagtgcactgcggttaccttttcttcacacctttgccaacattttcatcttatccatttgataatagccttccttactggtgtaaggtgatatctcatagtggttttaatttgcatttccattatgattagtgatgttgagctccttttcatatacctagtgtccatttttatgttttctttgaaggtctgctcatatcatttgtccatgttttaattgggttgtttttctgctattgaattatgtgggtttttaaaataaattttggatattagccattatcagatgtatgatttgcaaaaattttcttccagtctgtagcctgcattttcatttttaaattgttttctttgctgtgtagaaggtttttagtgtgatgtattcccattggtttattttttcttttttttattatactttaagttctagggtacatgtgcacaatgtgcaggtttgttacatatgtatacatgtgccatgttggtgtgctgcacccattaactcgtcatttacattaggtatatctcctaatgctatccctacccctcccccaaccccatgacagggcccagtgtgtgatgtgatttattttttcttttgtagcctgagcttttggtatggcatcccaaaaaaattattgccaagaccaatgttgtggagtttttcccctatgttccatgagttctatggcttcaggtcttacacttaggtattttgtccatttttagatgatttttatccatagtgcaagataagggtccaatttagttcaaatatcttaaaagagctcttgtttttgcttccattcagagtacttgtctttggtagatttttttatcagacaaaagtcattgcagatgtctcaatttatgactatggagatcatgcaaattttttttttgtaaattttatcctttttggtatatattgcaagtttatccaattaaaaataggagatttatcagactacatctcacaagtttaaatattctggagtccaataatataatttaaaaattaaatgttttacatagtttgtgcctttattatttaattggctccatttctacaaggatcagtttcaatgtcctcctctttacaacctttgcttttaagaattggaaattgataaagcttcacaagctaaagctttttggcatcacaattgctaaatacttttatttaagttcagtttcatagtacttcttcaagtgctcaaacacatctaaatctaattgttgatgaccagcacagagaaaaactgcatagccaccagcataatttagaatatgtttgtactgaaagccagcttcatctcaaaaatgcactacttttgttaccccaacaactagcgtctctatttcaattagtaattatgaataattaataatattatacatattatatataatagaaataataattagtaatatttgtaattagtaattatgaacaatcatgtgcacgacgaattccaagaacatttctattcagaaaagttcaaaaaagttttttaacttagtaagattattgtttccattctgcatgctttgtttactgaaacatgataaaaaagttaatcaaatttttttattcataccataacagcaaaaataataattttatctttaatgttaaactttaaactactttacaatataattcacagtaatgcaagatactcaacaaaatgaactttgtaaagtgttatttcatgtttatgactttaatgaaaacacaatctattagtggaattaacttattttctatttgaagcatcatttaaccgctagttcatcggctaatggaagtaacatataaacagttgttgttttataccttatacatgcaaaagatttcttaaaaccaacaaagagtaaattactttagaagagcaatcatttaatctaaatgaaaagtcagtctttaaaaagaaatacgtaggccaggcactgtggctcatgcctgtaatcccagcactttgggaggccaaggtgggcagatcgcttgaggtcaggagttcaagaccagcctggccaatatggtgaaacacagtctctactaaaaatacaaaaattagctgggcatggtggcaggtgcctataatctcaggtactcaggaggctgaggtgggagaatcgctggaacctaggaggtggaggttgcagtaagccaaggtcaccccactacactacagcctgggtgacagagcgagacttcatctcaaaaaaaaaaaagaaaagaaagaaatatgtaaatacaccatctgaagttgcacatgttaaattatcatcttgtgcataatctttctaaataactgtaggtgctagtgatttgggggatgatatacatcaccttgtttccacaggttcaatgatatcactacagactcaattgttatagtaaatgtcaacaaatactttgtgtaatttacacattcatcaactttcttgagaaatcgaagtatctttaaattttcattaaatatgcatttttcaaggaaaaagacatcgttttggaaaggatagtggttgaattaaatatagtaaataatgaactactttctatatattccatggtaagactattcagtctctatttctcacacatctcatacacaaccatggtacaaattagttggttcaccaaatgacctagaagcaatagcttccaatatttctcccaccaccaccaggatccacaagaagttggttatctccaggtcactcatattaaagaattagtttttataacagcattattgagatataatttgcatatcataaaagtatcccatttaaaatgtataattcaatggtttgtagcatactcagagttatgcaaccatcacatcactattgtaattttataatgttgttatcatcccaaaaaacccatattcattacaagtcattctccatcccttcccccatcccagctctaggaaatccctgatctatttctacttatagtttcctattatggacatttcatataaatctaattacataatatgtcaccttttgtgactggcttattttattttgcataatattttcaaggttcatacatttcacaccatgtaacagtactttgtttatattgttaaataatattccactgtgtgggtatgccatattaagttggtttattagagagtatgatgaacactattcttttcaatgcatcagaaaaggatgggagaaagggaagcaatttactgctgattatttctgagattcaaccacatgttaatctgaaaactctgttcattgcatgcatctcacacattactaattaagatggtgctgaaagtaaaaagtgaaattctatcaaaaccattccagtcaaaagaaacattagtaaaaatatttctttaaaatatgaaaactcaagaaaaaaatcctacgccatatgggatactgagaccacacatgtaagccaggcttatagcaggattatggttgccctatctgtttctcatactggaacattatattttttatgagaatagtagattagcataattcttgccatgtaatagcctctcaatatgaatttttgaatgagttattgaagatgttttcccaataagtatgtttatttcagttttgtgaatttttaaatatttttaaatttgtaagtattatggatacataatagttgtacatatttatagtgtacatgtgatgttttgataaaagcatacaatgtgtgtaatgatcaaatcagggtaattgggatttctattacctcaaacatttaccatttctgtgtattaggaacattacaattccacttaagttattttgaaatacacaataaattattgttaactatagcctccttattgtgccactaaacactagatattatttattctatctaagtatagttttgtacccactaaccatccctcttaatctcccccaccccactacacttctcaacctctggtaaccaccattctactctctacctccatgagatcaatttttctcttttttacctcccacagatgaatgagaacatgtgatacttgtctttctgagtctggctcatttcacttaatataatgtcttccagtttcatccatgttgctgcaaatgacagaatttcattcttttatgactgaataatattcccttgtgtatataccacattttctttatctgttcatccattcatggatacctaagttgtttccataccttagctactgtgaataatgctgcaataaacatgggaaagcagatgtcttttcacatggtgatgttctttctattagatgtataccaagcagtggtattactggatcatataatagtactatttttcatttttttgaggaactgccattgttcctcatagtggctacactaatttacattttcaccaacagtatatgaggactcccctttttcccatatccttgccagtatccattattgcctgtctttttaatacaaagccattttaactgggatgagatgatatcttattgtagctttcattttcatttcctgatgattaatgatgttgagtgttttttcatatacctgttgtccatctgcatgtcttctcttagaaatgactatacagttttttttctcatttttaaattggattatttatttatttttccaattgagttgtttgagctccttatacattcaggttattaatctcttgtcagatggatagtttgcaaatattttctcccattctgtgggttgtctcttcactttgttgattgctttattggctatgcagatgctttttaacttgttgtgaccacatttgttcatctttgcttggttgtctgtgcttttgaggtcttaactaaagaaatatttgcccagaccagtttcttggagtgtttcctcaatgttttcttctcgtagttttatagtttcaggtcttagatttaagatttaaatctttaaaccattttgatttgatttttgtatatggggagagatggggtctagttttattcttctgtgtatgaataccctattttcctggattgaagagactgacatttccaaatatatgttattagtaaatttaattgtttgtaaatgtgtgaatatatttctgggttctctattctgttccattggtctatgtgtctgttttttatgccagtgccaagctgttttggttactatagctttgtaatataatttgaagtcaggcaatgtgatacctccagctttgttcattttgcttgggatagctttggctattctgagtattttgtgtttctatacaaattttagaattattttttatatctgtgaaaaatataattggtattttgataggaatttcatttgaatctatagattgctttgagtattatggatattttagtaatgctgattcttcaaatcatgaatatggaatatctttcaagtttttgtgtcctcttcaatttcttttattattattattatactttaagttttgggatacatgtgcagaacatgcaggtttgttacataagtatacatgtgccatggtggttggctgcacccatcaacccgtcatctacattaggcatttctcctaatgctatccctcccctagccccctaccctgtgacaggctctggttaatgatgttcctttccctgggttcatgtgttctcattgtttaactctcacttatgagtgagaatatgcagtgtttggttttctgttcctgtgttagtttgctgagaatgatggtttccagatcatccatgtccttgcaaaggacatgaactcatcctttttttatggctccgttgtattatatggtgtatatgtgccacattttctttatccagtttaacattgatgggcatgtgggttggttccaagtctttgctattgtgactagtgctgcaataaacatacacgtgcatgtgtctttatagtagaatgatttataatcctttgggtatatacccagtaatgggattgctgggccaaatggtatttctggctctagatccttgaggaatcaccacactgtcttccacaatggttgaactaatttacacttccaccaatggtgtaaaagcattcctatttctccacatcctttccagcgtctgttgtttccttactttttaatgattgccattctacctggcatgagatagtatctccttgtgggtttgatttgcatttctctaatgaccagtgatgatgagctttttttcacatgtttgttggctgcataaatttcttcttttgagaagtgtctgttcatatccttcatccactttttgatgaggttgtttgtttttttcttgtaaatttgtttaagttccttgtacattctggtgattagccctttgtcatacgtatagattgcaaaaattctcccattgtgtaggttggctgttcactctgatgatagtttcttttgctgtgcagaatccctttagtttaattagatcccatttgtcaattttggcttttattgccatcgcttttggtgttttagtcgtgaagtctttgcccatgcctatgtcctgaatgatattgcctaagttctggccagggcaatcaggcaagataaataaataaagggtattcaaataggaagagaggaagtcaaattgtctctgtttgcagatgacatgattgtgtgtttagaaaaccccatcatctcagcccaaaatctccttaagctgataaccaacttcagcaaagtctcaggatacaaaatcaatgtgcaaaaatcacaagcattcctatacaccaacaataggcaaacagagagccaaatgatgagcgaactcccattcacaattcctacaaagagaataaaattcctaggaatacaacttgcaagggatgtgaaggacttcttcaaggaaaactacaaatcactgctcaaggacataagagaggacacaaacaaatggaaaaatattccatgcttatagatggggaaaatcaatatcgtgaaaatggccatactgcacaaagtaatttatagattcagtgctatccccatcaagctaccattgactttcatcacagaattagaaaaaactactttaaatttcatatggaaccaaaaaagagcccatatagccaagacaatcctatgcaaaaagaacaaagctggaggcatcatactacctgacttcaaactttactacaaggctacagtaaccaaaactggttactgataccaaaacagatatatagaccaatggaacagaacaaaagcctcagaaaaatgccacacgtctacaaccatctgagctttgataaacctgacgaaaacaagcaatggggaaaggattccctgtttaataaatagtgttgggaaaactggctagccatatgcagaaaactgaaactggaccccttccttaccccgtatacaaaaattaactcaagatggattaaagacttaaacgtaagacctaaaaccataaaaaccctagaagaaaacctaggcaatttctttaattaatgttttatagctttctttgtagtgatctttcacttctttagtcaagtttatttctaggcattttattttatttgtaactattgtaaataagattaatttcttggtttcactgctggcatatagaaatgctagttttctttaacattgattttatattctgcaactttagtgaatttatcagttctagtcacctttcgttggattctttaggtttttctaaatataagatcatatcatctgaaaataaggataatttgtccttttcctatccaatgatctttacttctttctcttgttcaactgctcctcctaaaacttccagctgtatgctgaataacagtggtgaaaatggacattattgtcatggtcaagatcttagagaaaaggttttcagtttttccctgttcagtatgatactagctgtgggtttggtgaatgtgttttttttttatcatgttgaggtatgttccttttatacccatttttttagagtttttattataaagtgatgtgaaattttatcaaatgcttaattgacattgattaaaatgatcatatggttttggtctttcattctgttgatgtgatgtatcacgtttttgatttctatatgttgatccatccttgtgtcattttgataaatcccattttatcataatgaatgacctttttaatgtgttgctggcttcagcttcctaatattttgttggggattttaacaattatgttcatctgagatattgacctatagttttcatttttcttgtgtatctggctggtttcagtatcaggataatactggtctcatagaattagtttggaagaattcccttttcattgatttttttggaatggctgtaatagaaatggtattagatatttaaaagtttggtagaattcagcagtgaagccatcaggtcctgggtttttctttgatggaagacattttattcctacttctatttacttgttattagtctattcaggttttgaacttcaatcttggtagggtgtatgggactaggaacttattaatttactctaggttttccaatttattgacatacaatttctcataacagtctctaatgatcctttgaatatttgtggtaacagttgtaatatctctattttcatctctgattttatatttaggtcttctctcctaagataactttgccatgataaggtgatggagctttatctgaaagtcactagcacaagcaatgaaatgactccatcccataatttatgccttatacaaatgttaatttcatatttatttctttgaattataatttataagaatataatattatacataaattaagataacacctacttttatacattatattttttgtaagtgaatttgatttaaatgtattatttcatttaatctcacattatcggttttacagagaggtggttatctcttccctgtcacaggttggcttccctaggaagctgactctgaaatggagattagcatacaggatgtttatcagggagtattatgggcataaacacatggaaaaagaggaagcaaaattggacaaagggagaattatagtcttgatgaaggatacagttgatcttagggaagttctaaaattgacatgaccctttagaattgtctcaagttgtgggagaaaggcagacttcatatctttccttgatgagtcattgggtatgggctgcccaaggaagggggcaaaatattgggcaaggggtgtgtctccaacaaagacattttctgtagaaggctaatagcggagacctgccttagggaagtacttatagaagtttaaaaaacaagccctttatttctacaagggatctgggcagcacactatctatgacaaacacattccattaattccttagtttttgataaagtttagaaatatttttggaatatttttatttctgtcagttaaaagagaaccaaccttgtaactaagactgacttaaattttaccttggtccctggctagttgtgtaatttggaataaactcagtaattattctgatacccattttttcttatataaagtgaaggagactatatttgatatataacaaaattctaatatttataagtaaaattgtgtggggtgtgtgggggggtggagagagagagagagacagagagagagagaggaagggagatgagccctattcagttaaaatgaagaaaagtaactatatcaactcacaacagattagcaaatggtggccctgtatcatattctacaaagtaagggcagattgtcagaggcactgagttagttttacactgctacataataagccaccagacttcatggttcaaaacaagctacatccatttattagctcagagttcagtagttcagaagtccagccacgtttcagctgggttctctggtcaaagtcttacaagactgaaatcaaggtgtcagtcagactggagtctcatttggaatgtgaagtcttttttcaaacttatttaagttgttgacagaatttagttcattgtagttttaggactgagacactcagaccctaatgatgattcaccttcacggaaattcaaaatatggctatttgctttcttgtttgaggccatagggagaatgtctctctgattctttgcattttaaaactctagacccccatttgatacctcacctgagtaggacagactctgattagataatttccgatctgattaacttaactgaatgtggaactttaattatatctgctaaagtctctattgcatataatagaacataatgatgaggttgataatgcatcatatttacaggcttcacccgtactcaaaagcagtgcattatacacaatggggtagaaatctcaaggattgtcttggaattctgcttgccatgggcacacagaaaatctcagcgataaagaggctgttggaggtagagaggttggtccacttgttctgtcatgtaataactcttagatacaggaaagaccttgtaattaaacattttccatctgagattaacacagaaatccctaaccaataattcaacttgacaagaacagattagatatttttcctgtgctgagtatggatgtagagttgtgaaatggaagacaagggaaatttagaaagatgtggagattcaaagtgttcaaccttgttgcatttgccacaatatttacatcctatttcttgggattatattatttccccagcagtggtttcttcttactttgagacataactgaattgagtatctcgtttgcactgcaactgcaattttgacagtccagtcttgatattggtcctcagtttatctgctctgccactttaggagataagggattggttcaaagttaccaccaaggctttctcgtttttgatttatattctgagttggaatttcacagcctttagttcctctttttcgtgtgtaaactacgtaggacatctagtaaaaggtaatgtatatacaatattaatgatcactattgtttttcaacacctaaactacccacaaaatttgtggttgattatgttccctgttacaggctgttgcgggaccagccactgccagggtcacttctgttcttgtgttcagctccagtcacccgcaccagtgacctcttctctgaaggtgagtgcctctttggagtcattgatatcatttcttaccaaagaacctgatccagcccacttcaattcaacagaaatatttgtataagaggaaagatcaagtttggtgttcttttcctcccaagataaatcctagtccctgtgtaaatcgctaacttcttcgcacagggacggctccttacaccaagtggtattgccatcttttcaggccacagaagctgctgtttcaacctggtctggagtaatgagtttcatagtggcttgaacaaagaaaatcacttaagtgattaaataaaaatttcaaaatttagtcctaaggtgatttgcaactctctcttcacacacagaagatattgatataatgtcctaaatgttccttcttcaggcatctatcttacacacaaatatgagcatattctatctattttgcacccttctttacttcacattatattcaattataatatttttcaatgactttgtaaaatataataataaatttaaatggccaaataacatataaaatcctttcaaattatatttaacaatttcatgtctaactgttatcattgaaatgttggtatagtaattttactattgatatttaacttgatcatgttgcagtctcttaaattaaacacactgatatatggagatttggaggatttttttaagtactaaaaaaggaaaatttatataacagaggagaagctgcaaactcatgggccacttatatcccattttctaataaagtaggagttttttatgtgacattgtgatggacttattgttgacatgggtaagttacagtcacaagttattcaataaatactaatttaggtgttactgtgacggtaatttatagagttaaataaagtcaatactcagttgactttaagagacattatcctagataatttagcagagcctcatttcaccagttggaaagccttaaaagcaaagctgaagcttctctgaggcaggagaaattcaacttgtggccagaatctgcagcccataaccaagagttccagcctgccgtatggattttagactagccttatcagtccccacaatcatataaaccaatttcttgaaaaaaaatcttacaatatctctcctactggtctgtttccctggataaatgatgatggatacagatgttgcttcttgacattgttctaaaggaacataatcatatggatgagttttctgaattgtttctggggtttgagaatttagttgcctcatgtgattatatttaaaggcactaatgactatttccggtgatagagcattagaaatccatggtataatatgacaaaagagatatggaaaatataaccattggacacttgtgatcaaatacctgtagaagttgaagttgtgggtcaccatgtatttgctaccttagaatatttttatcaaacctaagagtatcgtggagctggtcagttactcctcactgttccagaaataaaagaagtgcaggacttcaaattccagctcaagttccacctaaataatgtaatagtctgttttttatgccctaaaagtcaccgttatcttttctacctacaggtctgagatttctaaaaattaaacctgaatctccctgtgagtggcttaattacaacacaaattgaatttccaaccccacgaggtgttttctgttaaaatgattgggaaggaatgggatcctgaaaattggaatgagggcatattgacagatcccaatgaagctggggacactgaacccttgaatttggacagttttcttgctgggagaagcagccatccacccctgtctaaggaggttatctgttcttcctgaagaatctataattgccttgcaaggtactgctgattcttcttaggacctatctccacccacccctctctgcatctagacctacaattagacttaagtctcagcagagcccaaacggtaaggtacaatgaatgacctgcaagaagaacagaatgatttttccaatttatacacacataaatctggggaaataggtgtgggaatgggtcttaagagtgtggcattatggtggaaggaatataaagttggattagtctgatgtattactatggctcactaaggtcagtggtctaggaagggctctaacagtttgttttgtccataggttgaaacatgaaactgaaggtggcctacaataaatgaagttgaaatgtcaggattgccttggtatactatggaggaaggcatctaaagtcttagggaggttgaaatgtttgaatagatttatcatgtaagaactgctcatccaattggagagtccagaagacataccttttaccacaattatgagaaataaatttatagggggaatcctagcatccttgagagctctctctttactcttttctgcaagtcagatattacagtggaaactgctgctatttgacagggatcatcaaaaaccagatagtcaccacaataaactgcagagtcaaagcagttaccagaatactgtaactcccaaagacctacggcattagctagttgataatgatgtcactagaaaagaaatagatgggcagtctaatgaatgatgtgtataggtggaaaagttccaggtctagtgagcagaagtctaattcaaatcaccaaaacagagagacataacacctcaattaatttccaggctgagacaatttaccaccccagaaccccttaaatgaaagggaggctaagtccctttgaggaagaactccattgcactgccaaaaaaaatgtgtttatactgttaatctttcttctggtctttcctaaagagatctagttatttaccagtgtgcttttgctttggaaaatagaaataattagacttttggaagattactgaacactgactaaaatgacactaatttctggtcacccaaaatgtcactgtggaggcataatagaggcttatgaaggtttggtgattaattgatcattagttcatatttgtctcagtgggttcagcatgtccctgaacaagtcctgtgattatttctccagttccagaagcattattggaatagacacattcagaatgtgacaaaatctctacattggtttcccgacttgtgaaataagggatattatggaaagaaaaataattggaagccactataactgcctctacctaggaaaatagtaaactaaaagtaatgctgcaatcccggaggacgtaaaacatgtgagcatagtgacttcccaccacatccacattcaattcatctatttggcctgtgcacaaaacagatggatcttggagaatgacagtggattattgtcaacttaatcaggtggtgattctaattatagctgctgttccagaggtggtttcatcgcttgggcaaattaacacatcctcaggtatttggtatacagctattcacctgaaaaaaaaatgacttttttgttttgctatatatgttagtaaagatcattagaagcagttttctttcagttggaaaaaccagaaatacacctttactgttctacttacaggatgcgtccattcttcagccttatatcatcatttagtccactgggaccttgattgatttccctttctgcagaaaatcagtccgttccattgcattgatgacattatgctgattggacctggtaaccagaaagtagcaactgctctggacacttgtgtttcagagggtgggaaatatatttcgcaaaaattgagaggccttccgtatcaactaattcccagggtctaatggtgaaaggaaggtcaaagtattccttctcaggtgaaaaataagatttttgtatctgattggtcctcctacagccaaaaaagaagcacaatgcataggaggcctctttagattttcaaggcagcacattgttctttttgtgtgtactactccagcccatttactgaaagacctgaaaagctactagttttgagtagaagcaagatcaagaaagggctctgcatcaggtctagcctgctgtgcaagctgttctgacatttgggccatgtgtcaccagcaagccatgatccggaagatctgatgacatttaaaatgtcagtgtcagagagagatgctttttggagtctttggaagcctcttataagtgaatcataacacagactcaggattttagagtaaaactctgctattttctgcagatatgtacagtaagtcctcacttgacctgatctatagattctcaaaaactgcaccttcaagcaatacgcatgtttctggtcacagaaacatcacccaacttttaaataaagatgaaaacgcttctaatattaaatattaaaataaatatgggctatacacatatttaagaaaggttaatgaaaacaagtaagataattgtttacccaattattccagttcagggtcacaagtggctggagcctatctcagcagctcagggtgcaacccgggcaggaccccatccatcacagagtgcactcacacacacccacactcactccagtggggatgatttaaacactccacttcacctaacatgcacaactttgggaagtgagagaagacaggagtccctgaagaaaacccacacagacatggggagactgtgcaaactccacacagacagtagcctgaaagggaattgatttttttttcttatcaacattataacaaaatgacattatttgaggagaggtgtatactatttttgagaaacagtttttggcttggtcccaggtcttaatagggaccgaatatattatcatggaccaccaagttataatgtgatctgagctatctatcatgaactggttgctgtctaatctactaagcatggaagttaggcatgcacagcagcactgtgccagtcaatggaagtggtatatgtgaggcttgaggtggctttccgggcaatggtaagttacataaggaagtaacacaaatgcccacggccctactcctgctacattatcttctcaatctcagcccacaccaatggcctcattgggagtttcttatcagttaactgagaaagtgaaaactcagacctggtttacagatagttctgcacaacatgcagcaccagccaaaagtagaaaactccatcactctagctcttttctgggacatttttgaaggacagtggtgaggaaaagttctttcagtgggcagaacttagagcagttcacctcattgttcactttccattgaaggagaaatggtcagatatatgactctgtattattcaatggggtgaggctaatggtttggatggatggttaggaacttggaagaaacataattggaaaaattggtgacaaagaagtcttggaaagcagtatgtatatagatctcacaaaatgaataaagtgggtgaacatgttggcatctcttatgaatcttcaacaaaggattacgtcaacagagaatgattttaataatcaagtggataggaaaaaatgtctggatgccagtcatctctttcttcagacactccagccactaacgagctctgaacaaattggctatgatgtcaggaatggagatgatgcatgggctcagaaacatgaaattatactcactggggctttcctgacctaagtctatactctgccagcagcaaagaccaacactgagtcctcataatagaaccatgccccaagataacagccaactacctgatggttgcttgattacagagaactgctttcatcatagaagatacattgttcttactagagtagacacttcttctgaacatggacttgctttccttgcatacaatatttctgccaaaattagcacctgtcgacttagagaatatcttatccaccatcacagtattatacacagctctggtcaaggaacttactttgtagtgattaaatgtggcaatgatctcatgctcatggaatccactagcctgttacaaattgtcttgaagtagctgactttatagaatgttggacagtcttttgaagactcagttacactttcagctaaatggaaatacctagcaggagtcaggataggagcactttcctctaggatgtgttaatgctctacatcaccatccattatatggtgctgttttccctacagccagggtttatttgtccaggaattaaggagtggaaatgggagtaactctatgcattattacccttaatgatctctcagatatatttttgcattatgtctcctcaactgtagcctatgatggtctacagatctttgttccaaaaggagaaatacttccaccaggagacagaacaatgattgcagcaaaatggatgttgaggctactacctacccattttgggttccttgtccttcctaatcaatatacaaagaggaagttaatctattgtctgggataatagattctgattattaaggggatgctgggtcgctactacacatggcgggaaataagattttttaaatgtaagaaattctttatgatgtctcccacatcctatagctaaaacctgtattagtccattctcacgttgctaataagtacatacccaaatctgagtaatttataaaggaaagaagtttaattgactcacagtttagcatgactggggagacctcaggaaacttgcaatcatggcagaaggggaagcaaacacatccttccttacattgcgacagcaaggaaaagtgcagagcgaagttggagaaaagcaccttaaaaatccatcatatctcatgagaactcacccactattatgagaacagcatggaggtaaccgcccccatgatccacttacctcccaccaggttcctcctataacacctgaggattatgggaactacagttcaagatgagatttggctggcaacatagccaaaccatatcattccaccctagcccctcacaaaactcatgtcctcaaaattcaaaacacaatcatgtccctccaacagtcctcccaggtattaactcattctagcatgaactcaaaagtccaagtccaaagtcacatctgagacaagacaagtgccttttctcaggtccctaggagcctgtaaaatcaaaagcaatttagctatataatggggacaggcattgagaaaatacacccattccaaatgggagaaactgaccaaaacaaagggggttcaggacctatgccagtctgaaattcaacggggcagtcattaaactgcaaagttccaaaatgatctcctttgactccctgtctcacatccaggttagactgatgcaagagatgggctcccacaatcttgggcagctctgcccctgtggctttgcagggtacagccccactcttgggttttttcatggctggcattgagtgtctgtggcttttccaggtgcatggtgcaagctgtctgtggatctaccattctgggttctggagaatggtgacccttttcttacagccacactaggcagtgcccaagtggggactctgtgtggtggctcccacctcacatttcccttctgcactgacctagcaggggttctccaggaggactccacccctgcaccaaacttctccctggacatccaggcatttccatgcatcctctgaaatctaagcgaaagttcccaaacctcaattcttgtcttatgtgcctctgcaggaccaacaccaacgccaagacccaacccaagagttgggtcttgcaccctctgaagcaacgacctgagctataccttggcctcttttagtcaccgctggagcagctgggacacagggctcaggaaacttacaatcatggcagaaggggaagcaaacacatcctttttcacatggcagcagcaaggataagtgcagagcaaagtgggggaaaattcccttataaaaccacctggcgcggtggctcatgcctgtaatcccaacactttgggaggctgaggtgggcagatcatgaggtcaggagatcgaggccatcctggctaacatggtgaaaccctgtctctactaaaaatacaaaaaattaaccgggtgtggtggcaggtgcttgtagtcccggcttctcgggaggctgagacaggagaatggtgtgaaccctgggaggtggagattgcagtgagccgagatggcaccactgcactccagcctgggcaacagagcgagactccacctaaaaaaaaaaaaaaaaaaaaaaaaaaaaaaaaaatcagattttgtgagaactcactcactatcacaaaaataacatagaggtaaccacctccatgattcaattacctcccaccaggtaccttcaatgacgtgaggattatggaaactacagtacaagatgagatttgggtaggaacagagccaaaccatgtcaaatcaatggatacccacaacccaatccaggcagaactgctagtggacgaatgcttcaggcatgaaagtttggttcaattcaccaggcaaagaaccatgactagcagcactgcttgctgagggcaaagggaatatcaaaagagtacaggaagaaagtagttataaataccagctacaagagcatgaccagttacagaaacaaggattgtaagagttatacgtattccttccttattttattttgaatatgtttgcatatcttattaaccattttttaaaagtttcttccctgtcttattcccttaaatggctgttaactttattttgcagtaagttacaggatatcaaaggaggagagtgaacatcatccaaggatttggagtcctcttctgggaaaaaggtaagtatatgttcttttgtggaaaaaaaaaaaaaagcaggctgggcacggtggatcatgcctgtaatcccagcactttgggaggcccaggcgggcagatcacctgatgtcaggagtttgagaccagcctggccaacacggtaaaaccccatctctactaaaaataaaaaaagttacctgggtgtagtggcaggcacctgtaatatcagctactcaggagactgaggcaggagaatcacttgaacctgggaagtggaggttgcagtgagccaagattgcgccattgcactctagcctgggtgacaagagtgagacttcgtttcaaaaaaaaaaaaaaaaccaaaaaacaaacaaacaaaaccaaaccaaaacaaaacaagacagttgtgttattttgggtggatgcatgactttgttactcactttatttagagtttgactttaggaatgttaatgggtgccagactgacaggtggactatggtggtggttttactgtgtcaacctggccaggcctcatcctctagttattcaagtaccaatctagatgttgctatgaagctattttgtagatgtaattaaatcctaaaatcagttgacttttagtaaagggggttttactagataatctggtgggtactgatttaattagttgaaaggctttaaaagcagagctgaggcattcctgagaataaacttatgcttgtggaccacagcttccacctatgcccaatagtcccattcttcccttactgatgactcaccttatggattttggaactttctaggcattccccataagctaatttcttgtaacaaatttctcagtatgtatctcctaatggttctgctttatctggtgaactagactgtattagtccattttcacactgctgataaagatatacccaagactgggaaatttacaaaagaaagaggtttaatagacttaagagtttcacgtggctagggaggcctcacaaccatagtggaaggtgaaaggcacttcttacacggcagcagcaagggagataacgtgcagggaaactctcattttaaaaccatcagatctcatgagactcattcactatcatgagcacagtgcaagaaagacctgcccccataatttaatcacctcccactgagttcctcccatgacacgtgggaattgtgggagttacaattcaagatgagatttgggtggggacacagccaaaccatattataaactagtgtagacagatatcacctgtctgagactactgaacctgaattggtgatgagaaaaactcaaaaaaagagaaaatatttattaacaacatattcctctttaaatgtttggtagaattcaccactgaagccatctggtcttgagcgtctttttgttgggagatgtttgattaccgaaaaaatatccttactcattatggatctgttcagattctctgtttattcatggtgcagtcttagtagcttgtatatttctagaaatatatgcatttactttaggttatccaatttgtttgtatttgattgctcataatagtctgttatgatcatttgtatttctatagtatcatttgcattctattttatttataatttttcttgagtcttctttttttcttagcccagctaaggatttgtcaactttgtttatcttctcaaaaaaccaacccttctgttttattgatcttttctattgtttttctgaaaatgcaaacccaaaccacaatgaaatatcacttcatgcctgttagaatggctattactagtaaaaaaacaacaacaacaacaacaaaaaataaccagtgttggagagaatgtgaagaaaagggaatccttgtatactgttgatgggaatggaaattggagtagcaattatggaaaacagtatggagattcctcagtaaattaaaaatagaactactgtacaatccagcagcccctcttctgggtatatatccaaataaattgaaattaggaccttgaaaagacatctgcaagcccgtgcccattgcaacattattcacaataggcaagatagagcaacaacctaaatgttcataggtagattaatggaaaaataaactgtggtatatacatacaatgaaatattaccctgcctttaaaaaaagaaaatcatgtcatttgagacaacatggatggacttggagggtattctgttaaatgaagtcatccagacacaaaataaacagatactctacaatttcacttatgtgtggaatctaaaacaaactcttagagggatagagtagaatggggcttgccagggtctaggaaaatgggagaattggggaggtggtagttaaagggtacaaagttccagttatatgtaagagaagtaatttctggaaatctactatacagtgtagtgcctatagctagcaaaactccattttatacttaaaatttgctgagagggtaagatctaccttatgttaattgtccatatcgaaaaacagtgacaacaacaacaaaaatcccaataatgataataaaggagctgggaggaaactttgggagatgacaggtgtactatggccttggtagtggtgatgatttcatgggtttatacttatctccaaagtcactgtgagattgtatataaaataggtacagtttttaaacatgtcaatcatacctgaataaagtggtttaaagacaaaaacaatatattcttcataagcagttccacttactgtattttttttctaatatgagagcaattctccagaaacttcagctgtgggaaaataagaaaatcactgccaaagatttggcccattgccttataaattattgaatatatcggttattaaatttgtagcctacaaaaccacttctgagataacttggcctgcctagcatagagttaagcttagaataattttctagctaccaaatttcaggaaggatttgattttatttggttaattatggagaacaacaagctttattaggatttcattatagtcctctgaatcccatgagatttccatagttagaaatgaatttttaaagtcttgctgaaatagcttcgattatttcttgaggttttttaaaaatgatactttactttggtggcttatctgttgttgaccttaaagtgaccataatatactttttaatattttcttcaaaataataatgataagcacaatacagtatttttaaccataggcacttagctgtatagtagatctctagaattcattcatgtagcataattgaaactttataaccattgaacaactcctcacctctcttaacttgcccctgacaaccactgttatattctctgcttctatgagtttgactattatagatacctcacataagtgtaataataaactatttacccttcttgaatggcttctttctcttagcataatgtccttcaggttcatccatgttgtctcaaatggcaggattttcttttttttaaggatgaataattccattgtatactacattttctttatgcatttatctgtcaatggaaacaggttgttttcatatcttggctattgtgactaattttacaatgaacatgggaatgaagatgtctctttgagatcctgatttcaatccctttgaatatatacccagaggtggtattgctggatcatatgttaagaaggtagatttcctgttaggtgttcttcccaggaaaatgaaagaaaacaaaaacaaagggacacaaaaaaacttggagaagttgcatacatctattaccttgagtggtgatggttgtgtgggtatttgcatacatccaaattcatcaaattatacaccctgaatatgtgcagttctttgtatatcaattatacctcaataaagctgttaaaatttaaaaatatatatataataaaataacaaaataatgatgaagccaacacatgttaagaatttatcatatgcaaggcattctgagaaactcatcacaaggattacttcatttaatactcacatagtcctctgaagtagttgctatcattattccagtttgcagatgaagaaatgcaggcacagagaaggaaaatatttggccatgggtcacacagctaatggacttagttctgtataactgcagaactcatactgttagcaactgtggttgtctgtaattaatttaaagatagaataagttaaatctggtattttcatttcatagtgtttaatgtcctaatgattaatttttaagtgtataaattaatgttttattatcttcaaaagcaaataaagcaagcatttttttattgctatgatcccaattttttctcctctacaaaattgataaacaataataaagtgttcccatttctgatttataacataatgcaaaatgtattgttttcaaatttctaagataagaataaagttattttcacaattaaatattttagaagaagaagagtggtattcgggtattctaaactaataactggcatttccttattttccttctctccttcatctttccttccctttgcctctcattagcccaccttttacatgtacgtttgggtgcttctttctcgggcttataatcacataaagctttctataattcaatattactctaaatagtcatcctcatttgagtgagactggcaaacaggtaacaagaacaacattagtcattattttcatcttcttgactattctccttctccaaacatcttttgcttcccccttttaagaaagaaattatggatataagtgcactttaatatgtttacctaactggaggtttatgccatagcaacatggctcagtgtctcttcaggaggtatattccctgtctcctccctttcctttcatccctgtccttgtatttgtatgcaactcttcctctctctgacccccttcttgtttaacattcattcttctcttccattcaagaaaggaaatgtagaatgggaacataaagtggcattggagcaagactagaagtgctatgtttctccagggagatcatgcggccaatggaaatactttagtactggtgcttctttattagcccagggaattataagggtatttcaacctgctctttgtaataactccggggaataataaacagggaagatcagggagaagagccgccatgtttggtatggtaaagcatgcaacggaatccatagaatttgccatctcagtttggaatgtaagccaaatatggcaattggagatggcgctccacccctccgattcgcaagatatccgtcggtatttaatccagtctaattctgaccctgagtgatcatgggagaggagcccttagttgccaggctttccctttagaatactgtctgattaaatgcgctctgttactctggtagaaaaagggaatttaagtaactggcaccttgaaatgccctgcagctaaagatagctctaaaataaatgcataattgtgagctcccatgacatgtacagcacaagatgtccgagtgaaaattcaaagtcatgcgcatgtaagaaggaatgttatttcccaaccacacacacaccatgcaatttcattcagtgactaagagcttaggagccagactacttggtttcaaatcctggctcagaggcctccaactgtgtgattgcaaccaccccaagccttgattttctcttctgtacacttgtgatagcacttcccttatacaggggcaaaatttggttattgatcacaccgcccagcacatacaaattactcagtaaatgttaaggaaggaagaagatttagagtagctggctttcaacactgggggatgtgattgtttttaacctggattggggcaagtttgtgagagactttaaaacaactatagcaattggtagttatcctggggctcttagcattctagttgctttttcacttctctatatcaccctccccaatttcccttagcaaaaacaaggactcttttgtattttccttaccaccattatgtctatcatatagcaaacattaagaaataaggtgaacagactattttggtatcaattactcattttattccctaatcatagttcatgattccatctcttccaacaaaagatcaaggcctctcatttcttctatcagccacagaaaacgagttggacccaggcactggtggacacataatgagtctctgagtggaagaattctgtcctctctttgttatcctgtctactatatgtgttgtttatccttctgaatgaaaagagaattgaactccaattattctggaattcaatgctgcaagagttggcttggaaaactatgtgtccaacaatggaagactttggagtccgtgagaagaacagagttttatctgattatataaaaagatcagttcaggtgcagcctctccagccaagagaaggagggccctctctctacttcttactggctcctgatagcatatggtctaggtagtgcagagtgaaatagaaacatcacctcaaattcagtggctcactggatcaattcactttaatatatatttcataattagttcctttacctcctccccagattaaaaaaatcatttttatttcaaattattagtcataaaggatgtacttgagtcaatatgtaaaatagagggacttgataaagtagattttctttaaatttatcttgcaaaagaaaagtaaaacagtttttctttttaaaaaaaatagtaaaatcatacaaacttatgacagagcagggagtgggatacaggcctgaactgcaatgccaggtcttctacttaaatgccatgtactgcctctactgcaagacgataattacatttttttgtgagtttcaaaaaaatgctattgtcttgtgtcttaattattaattatagcaaaacatatagatctgaatatttctttttaaaatattttgtctttatcacaacagtgaatttctttattcaatgctactgccccaaattaaattcccactaaaacttacatcatttaactgtgacaaaacaactagtcaaaatagtattttagtcctgtgtaaacaaactaactaacagataaagagaactttcactgttcagctgattgtcatgaggctgtgctgactgagtcaaaggaaaaggtaaataaagcaagagactgacttcaatataaatcaatactgtctagaatcaacatgcaacacaacacttatgcatttaccaagaaatatttaccatattttgtatgttataggagggctgaaagaagtatcttagcacacaattgctgattaattggtggtatacatggagtgaaagaatcccaaggtaaagaaatgagttggtgatatgggaaacacacacacacacaaagaaatattctattaaataccaagtctgtctttgttttcagcatagatgtggcaacaacctattgaaaatttggaagtgagctggcaatatttagaaacaaatttagccctgctgagaaatatcctgatccaattacctgagtttatttcagaataaaataaagttgttaggaaacaaagatgtaacatcttgggaataaaattgtatgtgtgaaggtgtgtgtaagcaaggtagagagaatacaaaagtctcttcaattctaaatgattagttgcaataaactgtcttttgctggtgaatataataatgaaaaggcattaacgaaattgattttttaaaaatattgattgtcacaaaggaaatcattgcctctatttcaaaagtcagcaatgcagaaatgagaaaaccaacccatagtaaaactgcagaggtcagaggccaagttttatcttctctgtatgtgccatagcatataattggaagaaaagacctgacaaaggcatatttcccaatggccctactgagaagaaaatatctattgtggctagaactattaagatcaggaggctttatagcaatatttattcaccacagattaaattgtgaaaaatcaatatatttgtttaaaaaggtgaataacaaaaaaagtatattgttttctaaatctctttgaagattttcaataagggtgcaagtttttaccccacccatttccaaacacacacacacacagacacacacacaaacacacacacatctctcctgtttttaagtgcatgattgtcacctactttaatttatgccaatatccatgctagacctaggtgctctaattggatacaaaagcaataattgtaatgggatgtggttaacctctcaaaggcctgttagttcactcagctgtgacagctgggggaaattaaagtagttccaataaatcactcaaaagcagatagaaactgctaatagaaagagaactttaaggaaaaagaaatatctggtaaaaaaaattctagcattagagctatcaatctatcatttatttaaatcttactctagcttctgttcctccctagcatcttccataaagtattttaaaagagcaggctgaggtggattttcctaaatttgagtttctcttctatgggatttctgtgatgttttcttggctcaatattgacctgatagtaatttttattaaggtcccatgcttagcatcaaatacgtgtacactcacagactgaacatttaaaatggaccagcattatagcatggactcttggtattcaccactttagcatcccagactttcactactcaaaaaacaaaactccaaaggtccatgaaatcttgtgatttttgattaagtggaggcaaaaaaactttttaaactgttttgcattgcaagagtaaggtatgtagctcctgagtgaatttagttaactatccaataccctgtttatattgtatatattttagaggagaaatattaagtcatgttgaggttaaatgacttgttctgggactataagtggcggatagatggggtgcatttagtctagatctcctgaacgatgcctagcaataactaaaattataaatattccttcaaaattactttaaagctcaatgcaaatcttctctttttaaagaactttccaggtttacttctgcacatcgggaaacaaaaattttacttcaagttgaagagttgaattgtttgaagcacagttaaatgataattttatgtattttatacatttgtgaaatctatataacttggagttatcaacagatgttatagttaagaattcttgctgaactttgcaaattatctttattcaagacagaatctgaatgtcaaaacttttttttgcaattggcatcttttctttttcagttatttctctaggattccactgtgacatcctagcagaattctttttatttatttatttattcattttattatactttaagttctaggatacatgtgcacaacatgcaggtttgttacatatgtatacatgtgccatgttggtgtgctgaacccattaactcatcatttacattaggtatatctcctaatgctatccctcccccctcccccaccccatgacaggccctggtgtgtgatgttccccttcctgtgtccaagtgttctcattgttcaattcccacctatgagtgagaacatgcggtgtttggttttttgtccttgcaatagtttgctgagaatgatggtttccagcttcatccatatccctgcaaaggacatgaactcatccttttttatggctgcatagtattccatggtgtatatgtgccacattttcttaatccagtctatcactgatggacgtttgggttggttccaagtctttgctattgtgaatagtgctgcaataaacatacgtgtgcatgtgtctttatagcagcatgatttataatcctttgggtatatacccagtaatgggatggctgggtcaaatggtatttctagttctagattcttgaggaatcgccacactgtcttccacaatggttgaactagtttacagtcccagcaacagtgtaaaagtgttcctatttctccacatcctctccagcacctgttgtttcctgactttttaatggtcaccattctaactggtgtgacatggtatctcattgtggttttgatttacatttctctgatggccagtgatgatgagcattttttcatgtgttttttggctgcataaatgtcttcttttgagaagtgtctgttcatatcctttgcccactttttgatggggttgtttgtttttcttgtaaatttgtttgtgttctttgtagattctggatattagccctttgtcagataagtagattgcaaaatttttctcccattctgtaggttgcctgttcactctgatggtagtttcttttgctgtgcagaagctctttagttgaattagatcccatttgtcaattttggcttttattgccattgcttttggtattttagacatgaagtccttgcccatgcctatgtcctgaatggtattgcctaggttttcttctagggtttttatggttttaggtcttacgtttaagtctttaatccatcttgaattaatttttgtataaggtgtaaggaagggatccagtttcagctttctacacatggatagccggttttcccagcaccatttattaaatagggaatcctttccccatttcttgtttttgtcaggtttgtcaaagatcagattgttgtagatgtgtggcattatttctgaggcctctgttctgttccattggtctatatctctgttttggtaccagtaccatgctgttttggttactatagccttgcagtatagtttgaagtcaggtagcctgatgcctccagctttgttcttttggcttaggattgtcttggcaatgcaggcccttttttggctccatatatactttaaagtagttttttccaattctgtgaagaaaggcattggtagctttatgggaatggcattgaatctataaattaccttgggcagtgtggccattttgacgatattgattcttcctatccatgagcatggaatgttccatttgtttgtgtcctcttttatttcgttgagcagtggtttgcagttctccttgaagaggtccttcacatcccttgtaagttggattcctaggtattttattctctttgaagcaattgtgaatgggagttcactcatgatttcatatccagccaaactaagcttcataagtgaaggagaaataaaatcctttacagacaagcaaatgctgagagattttgtcactaccaggcctgccctagaagagctcctgaaggaagcactaatcatggaaaggaacaaccagtaccagccactgaaaaaacatgccaaattgtaaagaccatcaacgctaggaagaaactgcatcaactaaacagcaaaataactagctaacatcataatgacaggatcaaattcacacataacaatattaaccttaaatgtaaatgagctaaatgctccaattaacagacacagactggcaaattggataaagagtcaagatccatcagtgtgctgtattcaggagacccatctcacgtgcagagacacacataggctcaaaataaagggatggaggaggatctaccaagcaaatggaaaggaaaaaaaagcagggattgcaatcctagtctctgataaaacagactttaaaccaacaaagatgaaaagagacaaagaaggccattacataatggtaaagggatccattcaacaagaagagctaactatcctaaacatatatgcacccaatacaggagcacccagattcataaagcaagtccttagagacgtacaaagagacttagactcccacacaataataatgggagactttaacaccccacggtcaacattagacagatcaacaagacagaaagttaacaaggatatccaggaattgaactcagctctgcaccaagtggacctaatagacatctacagaactctccaccccaaattaacagaatataccttcttctcagcaccacatcacacttattccaaaattgaccacatagttggaagtaaagcactcctcagcaaatgtaaaagaacagaaattataacaaactgtctctcagaccacagtgcaatcaaactagaactaggattaagaaactcactcaaaactgctcaactacatggaaactgaacaacctgctcctgaatgactactgggtacataacgaaatgaaggcagaaataaagatgttcttcgaaaccaatgagaacaaagacaaaacataccagaatctctgggacacattcaaagcagtgtgtagagggaaatttatagcactaaatgcccacaagataaagcaagaaaaacctaaaattgacaccctaacatcacaattaaaagaactagagaagcaaaagcaaacacattcaaaagctagcagaaagcaagaaataactaaaatcagagcagaactgaaggagatagagacacaaatcccttcaaaaaaatcagtgaatccgggagatggttttttgaaaagataaacaaaattgatagaccactagcaagactaataaagaagaaaagagagaagaatcaaatagatgcaataaaaaatgataaaggggatatcaccaccgatcccacagaaatacaaactaccatcagagaatactatacatctctatgcaaataaactagaaaatctagaagaaattgataaattcctggacacatacaccctcccaagactaaaccagagagaagttgaatccctgaataggccaacaacaggctctgaaattgaggcaataattaatagcctaccaaccaaaaaaagacatgctagcagaattctttggagtcccaaaacaggacgttcttgaccacttgctgcctactgtctttgagtagcccaaaacccacagacagcactaaactggggtggtgggggcagattatatgctgctgagtggaagagttcccactccagcagttgggagggaaaagactgcagcaagcacaccccaagaggcttaggcagttcaatcctagtgccagcagagggcaatcatttctgttcctggaagaaacaactacattctccctacatggaaagaagtcaaaagcatgactcacaacattaagaggaataatatctacaaatcatcatcaacgacagccaaatataacttatttaaggtattgattcatataaggaaagaaaatcaagttgtaaaagcaaaaacagatagcttccattgaaatagaacgaatacccagcactttgcaaggctgaggcgggaggatcacttgagcccaggagttacagatcagcctgggcaaaatggtgaaacttcatctctactgaaaatacaaaaattggctgggcgtggcggcctgcacctgtattcccagctactcaggaggctgaggtggaaggatcacctgagcctggaaggcagagtttgcagtgagctgagatcataccagcctgggtgacagagccaataataataatactgtctcaataatagtgtctcaataataataataataacaataataataataaataaataaaactgatagaagagatgaacaaaatctttaagcaaaacatgaggttcttcaaagagacaattacagttccaaaaagactttctagagttaacaaatatatttctactatttaagaaattaaatttttaaaatgaaaggaaagagagaatgatgtatgttaataagccatttagggttttcaaagattaagagaaaaaagttgcaacaaaaagtgaagttctacagagctgtaatttataggtaaaagaacatgaggcaggtgaacagatctggaagatctaaggagaatataataggtgtcctcgaaagagctgccagactacagataggaaatgaatcattagacaaaagttaaaataaaaaaagaggaggaagctaccgtaatttgttgagtcttcagatcaaaagagacaatgtgccctgggccgtattaatggacacaaacacacacacacatacacacacaccccttgacattgcatgttaacattccagacatgcaaagagaaagagaaaatttttacaatctccagaaataaaattacaaaagaaggctagatgacactttccaaatcacctttcattaagagtaacttaaaatgtatgagtactaggcttaatacatgggtgatgaaataatctgtacgacaaactcccatgacaaaagtttgcctatgtatcaaacctgcccttgtacctctgaacctaaaataaaagttaagaaaatagtaataaaaatgtatttgacaaatccatcttgagccatgtaacagaggttaatcagaaatggtggggtagagggtacttgataaagtgcctcattaactctgataataatgagacagtaacttgatgagaataacacatagtaacattttatgaatatataatccatttactaagaaacaggttaattcactaaattactgtacctacctgtaatatcggctgtgagaaagtaaatcatggtatacaccatttctaccataaaatgaaactgtggtttgaaagaaaataccagctttgacctaatgactttagctttaaatatttgtctataccttgcaaactgaattgcttagaaattactaacctgatttacttcggaaagactcttccctggtgttcatcactgagaaactgtagtgtatgtgtgcaagaacacagactctggccccagacctgctggatttgcatcttagatccacctcttacctgtgtggtctccatgtcccatcccttatctgtaaagccagtgtactgagagcattcacctcacagagtgatggggaaggttaaataagtacataatgcacttagaacagtgtttgtcaccaacttagtgccacacgagcatttacattattttcattgctgctgtagttaatgtgtagttggctgtcattcagtgcaccagtatccggcaccagaagcagagtggacccagcacccttcccacgagatcatgggccacctcgtgtcagaacgttcggaaactgagatttcctggtttgaaacattagtctaaggccaaggtgaatgaaatagggtcaggtgaaatttaaaaaaccaaaataaaaaaacaaacaaacaaattaagtttaaaatacttagaaagttagattgtcagccgttactcttacagctacctgcccgtttgcctccagaaattgtttgctgacattctcgttcatcctaatctactatggattaaagttaaaattgtttctaaaataaaaataaataatgtcttggcaagacacaaaaataatctaacatggatagaacataagagcttaatgtaagatatgtttgttttggagctactcaactgtttgccatataattcctatttgtttattattgtggtttatctattttgggtgatgagggaatgggttatattttagatagctgcagtagttgtacaggtcttctggtaaatgaaatacagctaaagaacaattttttcctgctaaccaacaattctttccagtctccctcactctgaacttggaataatctcttttctctcaactcttttagtcaccaaatctcagccttttaattgtctcatttatagtctcttctccatttctatcaccaatattgtcctttttactgatgtttttatgatagcagaattactatcagtctcctatcttgatttcctaattaatcaccagtacatccagtttcaacatgaacaagggactttcttctctcaacataatttgtcttttcttttaaattctgaattgctcaaagacagggaccaggccgaggtgtggtggctcaagcctgtaatcccaacactttgggaggccatggcaggaggatcacttgagtccaggattttgagaccaccctggacaacatagcaagaccatgtttcaaaaaacaaataaataaataaataattttaaaaggaccatgttatattcatctctatatttccattttttttttatcagttttaatacctgatatacaataattggagggtataggagtgcgggtatggggagtttttatttttaattttacttccagggctaagagtgttgttattaagctcagtgcttttacattatgaagcttagtttacaaagccctttcgggttatcatgtgcttgtttaggaatcattggctttctttgtttttgtcttttcaaccttttcaaatgtctactgcatatgccaaaggcagaatctaaatctctggatatcatgtgtgactacttgaaaacgtgtctctccaactgttagagacaaaaagattctctgtaaaaaaaaatatatatatcctgaagataatctgattttaatactggaaataacaattttgatgagtaatttatgttaaaggaaaaaaatattacaagtgagtcatttctttgatgaaacaacaggtggcagcaaagggggtaatattggcatccctacttttcagaataattggaaccgaaaattgcttttggaagtccattttgaatcctgtcttaaaaccaataaaatttttgaaatatcagtatacagatttttagtaattatgttataagatattctgctttttaaaataattctgtttgtaggacaaatgggcagaaatgtggatcttttaagagttcccttggaaccttcatttaaaaagacgggtcactttttggtagatctaaaaagaagaaacataaaccaactaaacagatgcttagcttccaaacaaatgctcacagaacctctctcttgcattggccaaattttctcttcctataaagcaatctgtccgtcacagcaacatttcattgttttcaaatcaccaaatttagtttattgtaaggtttggtataagttgttttttaaaattcagaactaaaatcttttgacaggaaatgctaaagttgaataaagataattaatgtagtataataggtatcaggatttatctggaaaattaaaagagcaatagcattgattctaataattcctgagcttaaagtgcactttgatatgaattatctgcataaactaatatgttttctctatttatgcaattgtagcagtgacaacagctctttctgttagtgaaatcctctttcatatgtagtcttgtttgtagaggaagctaaggtctgagggggaagaatcctctttttactcaaaggggagcagaaagaaaatagtgaatagttataccaaatcactgaagtagctccagatgtaccaaaagtaacgatgattacaagtcacacactgaaagctacactcaagtttaattatcagtacagttctgatacatttaagacttcctatccacttataaatgtaactcccatcttctttctttaaaataaataacctgcacttttagaaatggattttagagatggcttatagcaactttattttttacttttcttttcttttttaaactggaagtgtgaagggagaaattttgccagatgacaagatgatttcaggagaggtgaagatccatgcagtgctataaaataagcagtaatgcatttatagtccccagatttcctttcatcatctcatcctttcctcctagtaatgccaccattacccacctcaggcccacgtgccttcctagttcttctttctcctactctttaaaacttactttgagatcccacattcacacacaacataaatacgttgtaacagaggccaaagctttgtgttaaagttctattgagcagaatttcatgctcccaactgtcaaatggagcgggacttaaaagacatgaagtcacatgggagagctaagggtattgaactgagactaaatcatgtagttgcctcttcctctgtttccacatacaactggctgaaaccattgcagttacacacagtcaaactcatttcagacatggccatggtatttgtctgcaagacacatgacttctatatttgcaataatacgcacacacacagccaatacaagctgaagcttataatagacacacatggccaatacaaccggaacggttcatttgaaatgatatgaagaatacaggtttaaaaatggcaaagtagatctctaatttagcagtcttaaggaacaaagtcgacagcaacattcatgcctttgaagacttcctctctaaaaacaaataatgatctaagctggctttggagtgtttgcttccatcacacagcaatggctctctcccaaatggagaaacttctaaagtcaaaatgtgacttaacaacagggaaaagatagtaagaccagtgaaaatagtggaaaggcaatcgacacaagggaagaaagaaaagagagtcataataaaggaattttgttttcagagcaggaagaatcacatgcaccaggactgtcaggttcagtcaaaaacatgtggaaaatatgtcccctagtcaggccactcttggcaatgaaccataactgtgagtgttgggtcagtatcaagttctcctgaacaccatggcttacaaacaggaaaaaaaggaagcatctgagtcaggtcccccccaaaaaaggacaacagtgtgtatgtcctcattgtgtttggttatctctaaatgaaaataaatgtggtgccccctggatcgccgccagaacaaggtgatgatatagagatggattcatgccactttctgttctcttgtaactcttttaggaaagaaaagttcttagtgcacaattatatcattaaaaacaagagctgtaaagccctcatgacaataacatgcctgattcttcacagattgagaataatcatgcttcaaagcccattaaaatcttgaagaaaccacaatttatgaggtagaaattaagccacacaaaatagacaaagctatactgagcaaaaaggacaaaattggaggacccagattatctgacttcaagttatactgcagagctatggtaatcaatacagcatgatactagcataaaaacagacacatagaccaatggaacagaacagagaacccagaagcaagtccatacatgtacagtgaactcatctttgacaacagtgccaaaaacatccattgcagaaagaacagtctttttaataaacggtcctgggaaaactggatatccatatgcagaagaatgaaactagactgccatctctcaccatatataaaaatcaaatgaaaatggattgaagacttaaatctaagacctaaaactatgaaactactacaagaaaacatgggagaaactctccaggacattgaactgagcaaaaaattcttgagtaataccccataaactcaggcaaccaaaacaaaaatggacaaatagtatcacgacaagttaaaatgcttatgcacagcaaaggatacaatcaacaaagtaaagaggcaacccgcggaatggcagaaattatttgcaaacaatccatctgacgagggattaataaccagaatacataaggagctaaagcaattctatagggaaaaaatctaataaaccaattttaaaatgggcaaaagatctgaatagacatctctcaaaagaagacatacaaatggcaaacaggcatatgaaaaggtgttccacatcattgatcatcaaaaaaatgaaaatcaaacctacaatgagatatcatctaccccagttaattattgccaaaagacaggcaataacaaatgctggcgaggatgtggacaaaagggagtccttatatgctgttggtgggaatgtaaattagtacaatcactatggagaacagtttagagatttctccaaaaactaaaactagagctaccatataatccagtaatccaactgctagggatacactcaaaagaaagaaataagtatatttatgagatatttgcactcccacgtttattgcagcactattaacaatagccaatatttggaaacatcctgtgtccatcaacagatgaatagataaagacagtgtggttttccattcctgagttacttctgtgttctcactgatgtgtaggagctaagctatggggacgcaaaggcataagaataatacagtacttgggaggctgaggcaggagaactgcttgaacccaggaggtggaggttgcagtgggccgagatcgtgccactgcactccagcttgggcaacagagaaagactcaatctcaaaaaaaaaaaaagatacagtagactttggggacttggggtgacaagtgggagtggggcgagggataaaagacaacaaatatggtgcagcgatactgttcgggtgatgggtggcaccaggagctcacaaatctccactaaagaacttatgtaaccaaataccacctgtaccccaataacttatggaaaaataaaaaaaaattaaagacaatgttgtacatatacacaatggagtactactattcagctattaaaaataatgagattctgtcatttgcaacaacatgaatggaactggaggtcattatgctaagtgaaaaaatccaggcaaagaaagccaagcatcgcatgttctcgcttattcgtaggaactaaaaattataacaattgaactcatagagatagagagtagaatgatagtcatcagagactgggaggggtagttggaagagaatagcggggtggaggtgggaatggttaatgggtacaaaaaatagaaagaataaataagatctagtaattggtagcacaactatagtcaataataatttaattatacatttaaaaataactaaaagatcgtatgtctccatcaaaatatcccatatactccataaatatacacctgatatgtacccagaaaaaaacattttaaaattacaaaatttaaaaattaaaaaaaaataagccacagatttgggacatctttctgttcaacgcagttcaaacagttaatcacattattgcacagatacaatccataacataagatcttaaatgcgtggatacaagccaatgtctctctaatgaccacataatgaaagtgtatataattaggggtatgaatcctcactagaaaagtatgtttctaggttttgggtactagaactcctccaacttctccaaatagctgagaccacctaggatttcaggatacagagaagagaatttgtttgattcatggaatgttaggacatgtaactgataataacaattataatattactgttatagatgacatatagtatatgccatgtagtgagggtaagcctgtcatgtgaattatctcatttaattctcacaagaccctatggaatagattctaaagttccacaattactggatgaacacccttggagaaaaatcagttctggaattccaaatattttggattttagaaaggcaatattagatagatagatagatagatagatagatagatagatagatagatacacacacacacacacacacacagagctgtgtgatcccagtgtaatctcatccatgaaccaatattgatatatcattacccactagagtcccagctattttaatggttttttgtttttgtttttgtttttgtttttgtttttgtgacggagttttgctcttgttgcccaggctggagtgcaatggtgcgatctcggctcactgcaacctccacctcccaggttcaagcaattctcctgcctcagcctcccaaacggtttttatctaacacccttttccaggatatcacattgcacttagctgccatgtctcctcaagcttctcctggattcagcagttcctcacactttccttgtctttgaataccttgggtttaggagaatactggtcaggtagcttgtagaatgctcttcagctggaatttatctgctatatttctcatgattacactggggtcacaggtttggtggaagaacccagaagtaaagtgttattcacatcacatcatatatattatgtgcatactatcaacatgatctaactctgttgataattaaccttgctcaccttactgaagtgatgtttattatgtttccattctgtgtagatatgcccgctattccccattttatactatttggaaggaagtcactatacctagttcatgttttaggagagaggaattatattacatctcattaagggtggagtatctacataaattatttggaatatgtctgcacaggagatctctctattctcccttatttattattttcatttgcttatggaatcaaggaaatttattttacactttgggttataatctaatatcactttgttttgttcaaatgattgtaactgtggtcattgggagttctgtcacttgtctcatcatgtatatctcctgtcccaaccctagaatcagtcattcctgtaattatctctggatctttatattgaagaatgttatgagaaactaaaatctgggtgctaatatgtgttcattgttattggaattttttcctagtgtttcaagatgacagagtaaaagaaaaatatatttatactaacgcacatatatacacatatctataagtatttctatatttaactgctatagtctgaatattcatgctccctaaaaattcatatgttttaacctaatcatcaatgtgctgatattagaaggtggggacctctgtgaggtgattagatcataatggcagaggcctcatgcatggcattagtgtccttattaaaaaggtcccagaggcctgtcttgtcccttctgccaggtgagaatgcagcaagaagacatcttccatgaaccaggaagtgagcctcaccagacacaaaatccactgttgccttgatcttggacttcctctcctccagaactgtgagaaataaatttctgttgtttataagctacttggtgtatgacattttgttatagcagcctgaaatcactgactgtaactacctgtgtctctgttaatctaaatgagttttcctactgatatatccaactctaatccattaccacatggatcattctagcctgttctccttgcatgtctgtaaattctcactactacagtaaaaatcctggctttgactatctaccatccgtttacttatttcttcaatttgagagtatatatatatagtgttttcagattttttagtctctaccctcatggaaaataactttatcagctaaaacacagtgcttatgtacagttccttttgactttagtcagtctccactcattttcagttacttaatgactcaagacatttttcttcactccattcagtgaggatatatcataaatgggtaatacagttttattcttttgtcacatttttcattctacgttggaatactccaatatcctaatgatgttttttcatatgttgaggtttaccttttgtgctgtaatcttctatgtgctttgataaatgtagagttccatgaatccaccattaaagtatcaaaataaaacacaaaatagtttcataactctaaacaatgctgtaagttcttctattcaacacttcctccacaaactcctaggaaaaattgcccctataactttgcctattctaggatgtcataaaaatggaatgatatattgtgtagtcctttcagagtggccttttaatgtcttatttatttaagatttgtcaaggcttttacatgacttgatagttaattcccctttttccctgaattgcattccattatatgaatacatccagtctatttatccacttacctattaaaggattacttccagtatttggtaactatgaataaagctgctataaacacttatattcagtattctctgtggacataaatcttcaaatcagttgggtaaatgcctatggagtgtgatttcagagtcatataataagaccattttgctttgaaaaaaaaaacctgcctaactgtcttacaaagtgactgcagaatgttactttcccataagcaatgacagtctttttcttttttctatataattgccagcgattgttatgtccgttatttaggattttagctattctaatagatatacattaataggatttcaatttgcaattctctaatggcatgatgttgagcatctttttacatgcttttttgatacctgtataaattttttgatgagatgcctaattcaaattttttcaccattttttaatcgggttatttgttttctaagggtttttttccctctatttagatactcgtactttataaaatatgtactttgcaagtattttgagtcctcactgtattttttattttctttacaatgccattcccagtgcaaatactttttaatttaatgaagttcaacctcccaattattttcatggattgtgatatgggtgttataactataaactcatcatccaacccaagattgtgtattttcttctgtgttttcttccaaaagatgtatagttttgcaattttctttgggttaataattcatttcgagttaattttaatgtaatgtgtattgtctgcatttaggtccttttttcccctttggcatatggatttccattgctgcagcatcatttattgaaaatattacctattctcagctgagttgtcattatcaaaatccagtttactgtatttgggtgggtctatctctaggttacctattctcttacactgatgtgtagagaaataagtcttgaaatcatttagtctgagttttcctctggttttttttctccttctatattgtatatggcattctaggtctcttgacttttcatatgcattttacaacaagcttgataatatttaaaaattactgtcctggaactttggaattcaattgagtatatatttcaagttgggaaaaaatgacatcttaacaatatagatcttgcatagaacatagaaaatctctccgtttatttagatagtctacttctttcatcaatgtcttgtagttttctatataccggaactatacatatatgtttgatttatatctaagtatttcttggtactattgtagattttttaaaatttcaaattccaattgttcattgctagtatgtaagaaaaaattaacttttgcatattggttttgtatcctctaaccttgttatgcttgactattagctccaggagtgtgtgtgtgtgtgtgtgtgtgtgtgtgtgtgtgtgtgtgtgtgtgtaaatccatctgtgaatacagttttattacttcctttccagtacacacacatcttatttactgtttatgttttattgcattagctagaacctggcagtacaatgtcagatagaactggtgagagtctatgtccttgccctgttcctgatcttggggagaaaatgtattgcctctcaccattaagaatgatattagctgcaattttttaataaatgtaatttatcaagttgaggaagttccccttctattccgagtttgctgacatattttattatgaatgggtgttggagtttgttttttgtcagttgatataatgttgtaatttaattccttaaggcttctgatttggtggatgacattgattagttttcaaatgtctttttatacctggaataaatgccactttgggatggcattttttaaatatattaatatgtagttttgatttaaaatattttgtcacatatttttgcattaatattcatgaaagatatagttttcttttcttgtaattctttctgtagttttcttttcttgtaatgtctttatctgtttggggtatcagataaacaaattgagctagaaagtgttctttctttactttgggattctctaagtcctcctcagagagctcttgcagctctttcatgtagaattatatggagtcttactgtagcagcaaaatgtggaggatggagagaattctacaatcttccaattaagtctggtcatttagtgttctgtctctcagggctgtggtcttcacatgtgtttcctagctttactccttcttactcatttcacagaagaaaaaaaaacagaagcaaagtagtcggagtaaatgtgtctaaaatcatgaagagctaggatttgaacccaatcagtaatatgacagagcttttctcataacttaaatcttctcctggttttctgaagcccgaactagcagaatattcaaaagcacacattttggtcaaggcctatgtacaatgaaggaacacctgaaaaaaatgtttgcatgcttttcccttttcagcctatatctgtcccactaatttttcgtgaacaaactgcactttaaagatcaccctacaggtcaagactctgacattctgtaatcagatataaacacagaacacttagccagccagctctgtggatttaagcaatttaatatctctaaacttagttttcccaattgtaagatgaagaaaataatagcatgaaattcatagtttcctgagaaaaataaatgaaatgatgtcggtataggtcttagcatagtgttgacatagagtaagtgctcaataaatattaaatagcatcacttacagactcataaatttcatcttaaagtgggctgagtattcagaataaaggagaaataaatgtttatccaaaggagtatttgggaatctgtgaggaaatagtttgatcatcataataactagggttttattttggtttttagcattctggggccagagatgcaaattaacctgccacatacagtcctatgcggtgaagaattgtccaagtcaaaatgttaatagtgaacatggagaaacacttatgaaaaaacagatcaaaaggaatgacagaaagtaggtactgagataatcaatgctcttctgctttgaggcatatttcaaatccattgattgtaacacaaaaagaaagcagtaggataattttaaatattattttccattcacattgggtacctagcacaaagtaccctaattctaacataacatgctattttagtgccaaattatttattccatccccaacttccaactccaaaattctcctttgtgaaatgtttgctatttcattgggttgttgattctctaaaatggctgtgtttttccatgtttacagacttagctctcaatatatctgctttatataaaatatctctattattccagatttatttttcttcatcttatcaacaaagtggaagcaagaggacaatcatataactttgaaactgcaggttttcaagacataccaaagctatttcaaaaatgtgaattaaaagcaatataatattttatgttctaactataagaaggcagctagctcagattacaggtagtgtacacagattgctcttattcctagtagatttaaaatgtatgaacatgggcctggcacggtggctcacgcctgtaatcccagcactttgggaggccaaggtgggtggatcacgaggtcagaagtttgagaccagcctggccaagatggtgaaaccccatctctactaacaatacaaaaattagccaggtgcactggcaggcacctgtcatcccagctactcgggaggctgaggcaggaaaatctcttgaactcaggaggcagaggtttcagtgagccgagatcgtgccactgtattccagcctgggcaacagagtgagactctgtcttaaaaaaaaagtatgaatttgataattttaagatataagaaatcagagacagtatagtctagtagtattgttttcactgtaatgtcgtaaataagtaaatgggcatgatcttttgagcacacaccaaggtttcctagcacatcccagagtcagctctatatcatgtccttactgggaattaattgtttcttcttctctctggttcacaattatcattgtgcaaggagatatgatcctatcactgcctgtattcacagaatccctcaaaaataatagcttctttttcattttgcttctctcaacatacagctcaagcaataataaaatgaatcaatatctgaaaaggcaacactagccactccacttcctttcctctccactatctctcttccaaggcaacagcaacaacaaaacatctcatgaaaattgccttctggaaaccatcacactagctcatcaggcatacccaaacctgtctcactcctagagcagatttggggtggttccatgatatcgcttccctagtatttctgccctgtacatgaaatgttaactatgtgtatcagttggttccatgaaattcaaaggcttcttttaaatcaaaccaattattcttctaatacaagactttaaaaaggaaacacaagatgtgttttggaagcactgaaacagaaaaccgtgagttctcctcactccaattatttatctttgaaatcctgataggttgctaaaatgggtttacaagcaagtcttttcagcccaagaaggtctcaattatctttttcttttttctcttctacctctcaaactcattaccctggctattgtcctatccactaagacactatttcacaggcattccccaatcttgggcaggagcaccattaattcgagcatttttctctcctctcttggacactgctagacccacagggtactctgcacttagtagacatctctgctttgtaccaaagacatcatgttgccaaaattatgcagcattctgttggcaaagttcgggagaatactttccttctcatctcttagaacgggaacaaaactctgtagtttacatcccaatatcttgtgttttctagtaaaatagagcttttaaacttttatatacggttatctttctttgtaggaaccagacaatcatctcggcataagcaagtgacagccaaaactgttctcagtttcattagttctgcccatctgaaatttggttacctgcgcaggcttggttgggatagcttctctcccaaggatcttttgctcctcatgtgaatatacttctgatgaaaatatcccatcatttctgattttgaccatgaatacaagggaggcacaaattggggactcccagaaatacttgggaggaaatttggggaggctaagaagtagttgtctgaaataaagtcatacgccaattgtcagtgaaacacaaaatacattttggaacatccaagtaggattacagtgggaagatgtaggtacaactttgtaaatataattgcacaatcaaaatgagtactaatccaggctcaaaaatctcattagggtaccaataaactcttacgtctaaggtgcctatggcaatgtctattctagttttgattcaagtcttcaactttctatcttcctctttttaccttttatcctcctccccctcccttttcctctctctctcacatttgtgtaatatttaaaagtatgattcagacagagttaaattttgatttcttaccacattactaatcgaattgtggtctgccagtgcatgaactgcttatttctggccaacaataagaaaagcacagaaatagatattaaccatttagaaacttgtattgccattgaagattaccacaacatttaattttaagcttgatgaatctagttataaaaactagagcttattttttctcttaactcggtttttctaacattttttattaatgtaatgaagggatccatctgtgacagatcagaaattaaaaaaaaagaaagaaccaccacaggtgattagacctgcctgaaccttttgtaacattcttttagcagaaaatgaatgtgtcatatgcatattggcttttccggaatccatgaggtgaatgaattttcaggcttggatgagtgttagaaactaaaataaactaaatgaccagaatcaccaccaaaatcagccctcataatagtctggcactaatgttgttgctgccaccgctatcacaatataaccagaccttggacctcagggggtctgttgctgtcactcactgtccctgaaatagcatcttccctctccccagtcctttgcattgctcaccctacattcaaactacggggttagaatatctcattggccacaccaacatccttccaagtgccttctgaaaatggctgttgggtctatgaataccggctgccactaacatctatcccatctgtggtagttcactttttcccaagagccagcctccgtttacaggcaatggagtagaagaagctgcttaggtagtcactgaagatattgaaggaatttaaatgagaatttgacatccaacatcaaggaagcattcctaaagtgtgagccacctactgttttgtggtaaatgaaaccactcatatataattgcctgtagctcaggagtatctgggcccctgctgaccatgtttaatgaaggacataaagccttacaattcccagatgcatgaactcgaatcaatattgttccttattgagttctcatttcctaaaaaaaagaggggccatcttatcttcaagacagtgtttcccagaatccataagaaagaaatatcaaatcttcacggcagtcgatgaaacacacataagattcttcagattacccacatgaaatgctagcatagcctctccttgatatcttgttttcctttataaaacatatattaatacagtaatttcatgttttctcagaagagagacacaaaattatgtatctaataagaagctgctattaaggaataaggcagaagaagcctataatagttggaataaaacacacacagtaatgtttcataggagacctaaagtactcataacttttttgtgtgatagaaaaaacaatgttttgttggtgggaggtgggaaggaaaatagaataggcttggggagagcttgttgttttctttactgcagaactgagtaggaaatagttccaatgacttagcatgtgacaggctcttagttattattcaaattaaagtgagtttctggagcatgtcatgtctgtaagcctgacatttttagaaatgacagtgtgtctgagaaaaagcttttagcatattctcagcggtagctaaatatgaaatgccagacttctccctgctctgctgaatgaatttttatggagaactgatgaatgattacattatcttgagggtgaaggagaatttaggatgtccttagtgtattttgctttagtctcccctttgtccctattctgcaaagaagtcaagtttaaaactcacagaaatgcacaacaattgtggtattatataaaattacaatgtcacaaagtgctaaaataataataattccactgatgtagagagggggaaataacatttaggcaaaagtaggtctaatacataatatcttaagtacaatgtgaaaaacatggtatgatctgtaaaaaaaaaatacgtcacttaccaatattacagttccaagtttcacattcatgctcaaatgaaaacttctcaagtgctgtcccgttacagaagaacacaaaacattattaaaattctatgccttggagccgggcacagtgactcatgcctataatcttagcactttgggaggccaaggtgtgagaattgcttgaggccaggagttcgaggccagcctggccaacctagcataaccccatctctaaaaaataaaaataaataattttttaaaaccctgtaactaggactcaaagcaccaaattctacctgtgtgctgtcaagtaagggaaagtcactcctttgacagactccaagagtccttaccaaaaaacctaatctgactcagcactattgagataatcatagtggtgttttcaccaggttgggctagtcttacaagtgtaaaaaagtaaattatagcattcccaagtaggaaggcaccatacacatcaatctttccaagtttaaatggccatattgatggcattgggtagaagagattatctgcttaccaacctgctttcctggaagtttacagaaacaactaccttttgctctgaattaacagaagtttttattttattttaggactatttcataagtactttcagagtcattattcagagatctgcctaaaagccccctctttctacagatgtgaaataaggaaaaatgcagataggagggatacgtgcatgttctctccattgcaatgtctgttgtgaggcgggaaggaaagggatatgaattctatcaaaattaatggaatgctattttcatgtcagctgatagaatttcatgggggcttttacaagcaatttaaaatgcatccactttgagtgtgcatattattacaggttgttgagtctgtatggcttgtcatttgaggccaaagcccattccttattcattcttccatgcccactgccttccacagtgccttgctaataggctcatacttcacttattaacacttaatcaaatctgaatgaatgaaagaagacactgagatttagactgtcataagaactacatttttttggctcaattttccttcttcacaaataataacaactattgtattagctggtttcacatgacaggcaatattctaattgctttggattctaacttattgaatccttataatgacattaggacattctactattacctccacacaaatgtgtaaactgaggcagaaagagattaagtaacttgcccaagatactgtagttattgtgtgtatgacccataacttcaactaaggcagcttgggtctggagctgggttcttaaacatttctctatgccattgaaggcacaagtgagttaaaaggaggatggcaaaactggcgcctctcaaaaatttttggaagtttcagtatctaagcagtttattatctcttattactttagcttttcactgagatcactttaccgataattcgctagacttctcatcttttaataaatttaaaacaaatctctttcccatagcacacaactttgcaaactttaaatacttctaataatgagagataggctctacttttttaagataaaattttaaagcagtatttctaccagtcctcttggaaatcctactatatgagggatataatagagtgaaatatttgaagacatagttaaatatgtctttttatttatttatttatttatttatttatttatttatttattctatgtgtctaaaatacaacttaatatttttcattgcaatagaaagtacatctgcttccatgataaagcccagcctttaactggccccagaccctggtgagcatgctctgggtattaaagcaccgacggttggtatatgtgtggattgaggtggaggatgaggtgtcgggggctgggttctgaaatcctacttactcttccaattttcaatttctactggtaataattaaattcacttaaaaatccttgtagcatttaaatctcatttcagattaaacttgtggtcatggtcgttgtggtagtgtcttttattgtttgctttttgtttggctttgtgtagggactaatttctgtgctgccacctttccaaagtttgcttctaaaaaaattgccatttcccagtccaactggatagagcagtgttgtattaatgttttaaaagcattgaatatggtgttagcacatatgctttcaactaccacatattttaggtgtaacaaccaaatcacttgacttcatttgctttgtcttccttatttgtgctatggatatcatgctagtccatttcttacagagttgtttcttcattcattaatttattttgcaggtcaacaaagagttcttgagcatctgccagaccaagtacagttctagacatcaaagaacctacaatgaataaagcaagtctctttcttcaggaaaattacagcataatgttgttgcaattaagtttttttcatgcatgtaaaaccctcgtgcatacatttggctgatacatactgaactctaaaaacacattactacccattttagtaattaacatttggcattcgccttgcctatgagagtttagaagtaaaagaacttattttcagctcttaggccctgattatctctgggggatcacaaggactactaactaaaaaaaatgaggagtgggagagtggagggaagcacagtatgggtgattaataacaattttgctagagctctgtgaaaagctgcatagaaagggtattttatatttgatgtttgagcagaatgtgaggaacaagatttgacaactagataagaatggaaggagtaatctgggcagaaggaacagtatgagcacaagctgagaggtgtgaagcttcatggcatgcatggaaaacagcagcaaaacagtctgacaggagtagaaagcaccagagatggcataggcaaggcaaattatggcatattataaacagcttcaagtgcgatgataagtcagaagctggaaatcatcctaaatataatgcagaaaaatatgaaggttttaaatcaggaaatgagagaatcaggtgtgcactctagaaatttaacagttagaagtacagattggagtgtgcaagcctggagatgagcatgtacattatgattttaggtaatagtttaggtaacatataaagaagtagcacagtgaggtgaaagggtagatagattacaaaatcatttcaaaggaggagaaaaaagagatttggtgaaaagaagtagataaagaagagactgaggaaagcaaatctttccaaatcaccttttaattatccttttggaggtgatattaaatattgaaggggtcaatagtccagaaggacagagagagagagaaaggtaggaagaaagagagagaaagagcagaggttgaggggagggaaaagatgtttggagatagatggatgtgatgccagtaatttggaaattaataaataaatatatatatatatacacatatatattactatatatgcataacatttgtcatcattttgagaatgtctgttgaatggctaagttgttatagtttttaaaacttaggaactcaaataaatcaaagatggcacatgcagaaagagggtacaatgaagaaatacggtccaatttcactaaacacaaataaaatagattcacagataaagagggcacacagagggactacaagtgagattaatgtataagacctgagaactgaagactcacaattgaaaatggtatcacggagagaaatacgtatttttctcacacattttagtacattaaatagaaaacataatctaaaaactaggaattaaagaaactcagtgaaacaggcatttatgattccactttgcatatgagaaaattagggcttagtagaggcatcatggccgataaagagatctgacactcaaactccaatctctgtccctttttcttttaaataatttgaaagatttttccattgtatcactccttatcttttagacatcaataagataaggtatttagtgatatcatagaatactgacttactgtcttaaatagaatgaaatggacttggtaggatactaacggaaagcaattgagttgttacttaccattcccattaacaccagctacggcataataaagaattattaatatgaccagcaaagtccaacattaaaactgaactttctgccaattaaaaacatttgcactccttagcttgggcctgtctaagatggaaggtactggcttgttttttctttacctgctctagtttctggctccttcagaatgagtaaattggggtgtcagggagagggtaggggacagcaaaggtgctaagacactggcaggattttaatttggtcttctggctctttctctcataaggtgcttttgtggatttctcaggaatgtctgtcatcaatggggatctctcattacagtttcctggaggtggaaatgcctccttcaggctggctgacagcttacaacagcccatcacctttcttattttttatttttattttttatttatttattttattattattatactttaagttttagggtacatgtgcacaatgtgcaggttagttacatatgtatacatgtgccatgctggtgtgctgcacccattaactcgtcatttagtattaggtatatctcctaatgctatccctccccctccccccaccccacaacagtccccagagtgtgatgttccccttcctgtgtccatgtgttctcattgttcaaagcccatcacctttcacttctgcatctggaaatctgtttccaggctccttttgaagcattcccctcactctgagtgggaccatctcaagacatctccctccatcatccatcattggtgctgttgtgactggctcccagtgtggcctccttactcagttaccaacaaaccaacctgtctagaagttaccatctgtcatgtgctccccaactcacagggacatacgtcccaaattctgtgataacttcttgtgaagcacgggtgtaccttgaaacacctcctttcccatatccaagtaagaacagaggctgttgaagtcagcttgtaaaatgatctccattaaacaacaggtcagtttcccttcccctccatatttctcagggaagcttctcatttctcagccacacacatacataaacattttacatcagaagtaaaaactctgcattaattctgtgtgtgtgtgtgtctgtgtgtgtgtgtgtgtgtgtgtgtgtgtgtgctgattgtcctacagcaaatgatgagcagttatgttttctttctttatggggcaaggggcatcacaggaaaataaaagaatgatgttcggtatctcaagttttaatctgcaccaaatcaacactttatataccatccgccataataggaaaaccaaaaacgaaatatgtagtctgtgtctattcaaacatgcactcctgaagccagttataacagaggttctcatgctgcagctcctcttgccaatatgttctgttcatcatttctcctttcttcttcttgcctagccttttcctgactcccattcattccactttttctaatgacattaaaaataaccttttcaactgtcctccctgaaaaatgattattatggtgggttcatagatctatttttattgtaatttagtctgtttctctggcgcatgacagtaaatttgttttagaagtaattatatcacatgagctgagtcaagatccgaagagaaatctgctatttcttgaaccatctctatcaacagctttgcatgggaaacaatattcagtcaatgccatcttcatgcatgatggacagctgttatcaacgacaaaaaaataaaaaataaaaaatattaagatattagcttgagaaaaagaaaatttgctaacaaaacaatctctgtatgggatatgcattctgcattcatcaatgtgatgattaagcatattttcaaagagagaaacagaatgtgatattagtattgctagctcttattttttactttttaatgtaaatatacagtttttaaattttaagaaataaaatctaatacaaaactacattcttattttcagctcttgattttggctttcttgtcttttgtcagtaataacaatatgacctaccaacccccaaatactctaggtccattgcacttcacactgtttaacaaacaggactgctgggctctccctggctttatagtgttgatcattatgccaggcaagctttcaggtcagctgtctctcctaccacccttttcctcctgcattgccctgaacacatgccaatacttgcacatgcatacagtctacatgaatagtgcttcccaagtgcttaatgtttactgaacaaacaaatgaatgagtgactgaataaaggtatattatggatgcactcttgatttgctacataatgaaattgaagtctataataagcactgtgattaaccaccttttatttgtgggctaactcattcctttagctgctttgtaagaatagtagttgcaaatgatctctctgtttccttcctcctccatactatttccaaattctgtttgataatctggcattaacagactgttacttcctttgttctggaaactactttcttcaaacaaaaaatatcaatccctctttgcatgacctttcattctcagcctctcaaatgtggctacctttactatcagacaacaaaaattattctcattaaaaccaacaataaccttccaattgctaaattcaaccatctgtattcatctatattcagtcctacataactttcctgcagcacttggcactgttcatcgtatctccctctttctagaaacgctaattctgatatctatatattccactctcgacatcgtctagcaatcctctggccattcctgctctttcatgttctttgcacatcccatatgtgttggggatcccagagctatgaccttctaattgtggaaaaattactctcccttggagatacactcccatagctttaattttatgcagatttcaactatgcctttagctttcatctattttccaacctgtaagccaaaatttctaattgtttactggaacaataaactttgagactgcacagctccaacttaatattgacaacaaaattcataacacacacacacacacacacactattctacacatacttctatcacagaggaattctgttttgtgttcactggcgtggactctggtgtcatactgcttgggcttaaatattggctcttgcattgccagttgtatgactttggacaaattacctaacctccttgtgcttcagtttctcacatgtatagtgggaatcataacagcttctcctttttaagagtgttttcaagattaaaaggggtagttcatgtaaaatatttagaatagtgtcaagcacataataatcactataaaggtggccatttttagccatcattgtagttaccacaacataattaacttttaaatctatatagccccaccaaacagtgtgttctataatggtaggaaatatttctctttcgtaagattcccaagtaggtcttgatacatgaaggatttttaatgaaacgtgtgtggaataagtgaaaaccttatctgtattttatgttctcaagttaatgacttcccactataagaacctcagttctactgtcaactaccctctcagtcagtcactgaaatctgttgagtctgcattagggacctctactccttgtctccactgtcactgacaatcttcattttacctgcaatgaactgaatgtttgtgtgccaccagattcatatctcaagcccctaatcccactgtgataatatttggaggtgatacatttaggaggtaattaggtcaccagggagggtccctcacaaatgagattattagtgcccttacaggaagaggccagagagctctcttgtcctctttctgccatgtgaggacacaacaaaagtcagcagtctgtaacatggatgacagccctcaacagaatatgtccatgctgatgccctgatgacacacttccagcctcaagaactatgaaaaataaatctctgttatttataaatgacccagtttatggtacattgtgagagtaggctaaaccgaataagacatctcacttgaactgttaaaattactccctaactggtttctgtaacaagacccttatagatatcatccctagatttcttttttaaacagaaaaaaatcaagcatgtaaattcccaggtttaaagcctctcttggttgcctactgcccagaaaataaaatccaacctccccagttgacattcaagacttttcagactctggttccagcgtacaccatctcctgccacttccctcaaggcttctgccacaccaaatttctaaaatttctaagtgttcatcaaacatgccaggtttctataacctccaagtctttgcataagcttgaaagctttctttttccacttttgtccattttcataatcctaggacagtcttagtcatcctttaagatccaactcaaatgctaacattgctacaagcctttcctgacaccccaagagaatttctcattctcttctcaaagattccacagtgctttgtttctatctcttaacgacatttatcatgttacactgtttttatcgtttacctgtatgtctcctccattaaactacaacaaactcttatcacagtaactatctatctgtctccccctcctaaaaaggctgaccagtctaagtaccaaaaaaatgattactaaactcatcatccaatcaatccactcgctcatcagatattttagcacctactctctatttgatattgtattatagttttagcttaaaaaataaaatgttcctctatataaactaaattataagctggccaaataaaaagatttccttcattttttttcaattacaggaagtaggttaattaaagagaacaagattactgggaggttggttaggagtgtgcagaggaggtgataatgagaatttttttttccatggaagaagtgagattaccaccattagggacattttttatttcactgaagaagtgtgacttccagaaaataaaaggcaagtgctgtgaactcaagacaatgaatttatgtctagcctgagatgccaactatttccaggcatgcttcaaaatcatttgctggggtcaatcttgcctttctcctaaccacttcctatattttccctcctgtttcccccaactatccatgctgaacattttctgtaggaaagcaagattaggcaaggaaaagaggagatgtgaagtttggtggtagggaaatgctttatgaatgacaatgaaggaataatttgttcttgcatgtttttcatcaatcaatgaatgagatttttatccccagtgtgcctcaatgcaaggcattggcttagttttgctgtcaaacagtggtgccacacacaaggacacagagaagagctgtagaggcaaccaggtactttccaccttccctatacttagcaatagatagcaaaggagtccttgtgttcattctgcattgcccttttaggaaaaagatgagacaaattcaaggtaaagtaatttaacagaaagacttgtctacacaaattcctaataaatgaaatggacaaatgtagtcgtggaatggggcctggattaaatgccaagcactgctaaccaactgtgagatctcagctgaggcacttgttttcgctaggtctcagttttcttctctgaaaacaaggaaagtggatcacatggacatccctttctgctttaatcagaggtaaggtctgaataaagtgcagaattctacatttcttcaaacatagcacgtcaggaaaaaatgtgaacacaatgaagtccaagcttagacaaatgataattaaacacataattgacaaataaaaaggcaggtagaattctcattcttccattctaaattacagttcaagctggtgattatttaagcaaaaatgtaacttttaggaggaaattgaattatttcccactgtaaagaatttttaagatggcaaacctaaaattaatcatgccaaggttcctgctcgtgcttaaatatatgcatgactccatgtcattttgtagtgccttcctgtccttgacataattttgttttatatacttaacacaataaactctttcatagaaaggagaaaatgcctgcccttctggagaatcaaattatctaaactgggtccattgttatttccacaaacaagtggaggaattattgctatattccttaacgattacagacagagaatacaatgtttcaggcccttcacctttattccatccctttctcagcaattacagaccgagaatacaatgtttcaagcatttcacctttaatccatccctttctcaccccttgggaaagcccagcattagaaagagtccctagtggttacacttttcacttttgcccccaagaccatcttcgaccttgattgttgggttgttgagttagtcctcaaggtctctatctgcaaagtagcacttgataaccagctgaatctatagcccactaaatttgcttgttcttatttttagacattagttccctaaatgaaataaatgagagtaatattagttacatcaatgacaccactaaagcattcattgagcttcaataataagtgtaacaataacaataaaattttatggctccttttctcagaggaaattagaacactttaccaacattattgtctcattaaacctcatgtctttgaaaaatggtgtagcattgtgtggatggaagggtataagccagagagtgagacagaactgttttccatttacctacctggaaatcatttaggtaatgagtaaatgagataatgtacataaagtacatgcctgcagggtaagtactcaacacataattctctttccttttctatctctctgcccaccagccattctctccctcccactgctcctgcaacatcctgttccccatttttttgttatagagtaatgcatgttgagacaagtttgtcaggttttgtggggaagttttaggttgttttttggcccagtaatattctgatcccctctgagaaaaaaaaatgcacaaaagcttactatccttgtccatctggtatgcatgggcatgttccagctcctagcttcagtaaagtctctagagggtaggacaagtaactcctctctcagcattactcttactaggcaggttcagaagagtcttaaatttgaggcatcataatatctatactttgggccctgggtggaagaaaaaaatctctaagtagagtttattagtctgttctcaagctgctgataaagacgtacctgagactgggtaatttattaaaaaaaaaaaagaagtt

SEQ ID NO: 505 - DNA, 8883 bp, Homo sapiens
gtgtgtaatggtggatgagagctacaaagtaggggtggctgaacacagtctacaggaaatgcccttggctgttgtttattttttctctcctaggaagttgttgtttaaggagcctaattctagttcggagatgcattctaagaggtcttgtctactactttgtctcccaaaagtaatctcaattcggcttgtctgtgtacatttacatgaggaactgaactgttgttttcatagataaatgagagactgagttttctcagctctgaagagaaagggcatttgctcctcccagctgaaaggtgcccctgggtgaccgggggccttgtgggagtgtctggggggttgacccccatgacatacaacaaccccacagggaaatctccaacaaaaattaatttaaaaaaaagactcatccaggaaacacgtataaaaactgatcacctggcattttgaaccctctcagaagtcttagacctctggagagagaaactgagacacgtaagagggtgaaacaacttagtggtgacacattgtggagtctggccacaagcagcacacatcaaaccaccacacaaaaaacctgaggccacagctcagttccccctcttcagaaaaaaagtgagacataatctaatgaggagaaaacaaggagaatgacctccttttgaacactctgtaggttttatgacacctctacttgccagagtttatgtaaaatggaatatggtccttgtacacacttacattagagaaaaagagccctaagtttgacctgcaaactacgttgttcctaaattctttttcgctatttttctcttctgcctgctttaaatctgctgttatttttctcttcagataaaaaccactgtttagatccaacatattcattttgcaagctggtgaatttgtatttatctcatggctaaagttctgaagtaaaaactataaggtgtgtgtgtatttaaaaggactttataatttctataattttatgttcaaatgacaattaaattcatattaatttccctctaacacagactttttctctccataacttacgatgtaaattttgccattagatttttacccgagttgtttcctttaatatacaagtttaagactatttaactgacaagtgcctaagataataaaacaggttgttaagaatttgaaagtctaagataggaaaaaaaaagttttttatgaactgataggaagtacttccactggcatgcctaatacatctatgtatttatgtgttgtatatataatatatatataatatttcactactgaaaatatataaaagaactctaattggcttaagaaaataaaacacttgaatcaaatactttatcaggaaaaaagaaaagactagtcaaatgctctttcaagtttatgtaacaagtaaaatctttaataaattaaccttaacattattggtaaagtaatattagaaatgtcttaataattgccaacatacattgttgtttgcatttattaattaaacaatttcattctatccctgccaaatactataaaggtgtcaaaatttggtataggggttacaaaactataaacacagcccaaaaacagaatgatctttgcttgtgtaatttctttttttttttttgagatggagtctcgctctgtcgcccaggctggagtgcagtggcgcaatcccggctcactgcaagctccgcctcccaggttcacaccattctcctgcctcagcctcctgagtagctgggactacaggtgcccaccaccacgcctggctaattttttgaatttttagtaaagatggggtttcaccatgttatgaaggatggtctcgatctcctgaccttgtgatccgcctgcctcggcttcccaaagtgctaggattacaggcgtgagccactgcacccagccaacttgtgtaatctttaataagatattgatattcatttaataaaaaactatatcttgaatttagtaagattaccataactcctaattttgtgactttagacggtctagtctacaggcagtaaggtttgtttggggaagggtttgttatcatctttgtttcaaagctaaactataaattcctcccaaagttagttcagcccacaccccaaaataaacaaggacaacttggaggttaaaactgagatcactgtctcagttataattttacaatgatggttccataactttaaatgatgattatcacagttttcagaaataatctaggtaaatgacttctgtctaatttaaaatgtatttaaaggttatgtataaaacaagataaaaggaacccagaagtaagaaagatgtgaagaaagttataaaagtaaagaggtttttttttttttcggtaagaaagcgtaaagagaaatgagaaagagtcttgtacggtagatttagtcctaaagtaaaataactgatggtttaagaaagagggatgttcaggacaagccagaaagtccaaacatgttatgaacagtctgtgtaagtcacaataagaaaattcattttttaaaaaagttttatatgatcaagttgtcaattaaagagaaagtataatgatctttctagaaattgggcttgatgttaaaaaaaacacttctacactaaataattggttagaacaatgaaattttcttaagggattgacttactcttaataaattacaagagattttaactttttttagcccaaagttcaactttcattgcatctcgccattttcagttttctttctccttttaaagggcacaaaatagtaatgctctccttcaactcattttcagctcatacttttaaatacaagtacttttaaagtacttgtgacattgagttataggactttgactcctgggactaaaaaggacaccaagtcctgctaaatcttaaacactgacaacaattaaagcctcatcttcaggcccaatagaagatgtcaattaaaataaactacattcctgaagtcacagggccagaaattaaaattattcaactcctcaaggcccagggactatcacagaagaggtgaatatgtgagatttttaagggctgattttgagagataaaataagttcagtttccctataaattaataattaatatcaaagacacactgatacaagaccaatgcataagcccctatgtcagattaacaaggtttttttgaaacattaactgactccttaataaaagttataaaaggtttatggaaattatatcttatggtcaagatttaaaaaaaaaaattttttttgacacagagtctcactctatcacccaggctggagtgcagtggcgtgataatggctcagtgcaacctctgcctcctggttcaagcaattctcctgcctcagcctcccaagtaactgagattataggcacatgccaccatgcccagctaatttttgtatttttagtagagacagggtttcaccatgttggccaggctggtctcaaactcctgacctcaggtgatccacccgcctcagtctcccaaagtgctgggattacaggcttgagtcaccacacctggccgagattaaaattttatagattgcttataaaatttttaaaaacaagggctgggtgcagtggctcacacctgtaatcccagcactttgggaggccaaagtgggtggatcatgatgtcaggagatcgagaccatcctggctaacgtggtaaaactctgtctctactaaaaatacaaaaaattagccaggtgtggtggcaggcgcctgtagtcccagctacttaggaggctgaggcaggagaatggcgtgaaccccagagacgcagcttgcagtgagccaagatcacaccactgcactccatcctgggcgacagagcaagactccgtttcaaaaaaaaaaaaattgtagttgccttcatactgtttattaggacttattgtttggaaaattaagtgtcctctctcaaagaatgaaagtttttgcctttttttgaaatccttgagttatcactttggtcaaatgaatgacttgttttacaatgacctgtgtttttaacctttgatattttacaaaatttccaaaatcaaattataaattttgtctttttctgacctaattaatcctttaagatattaggttccctaaagtcaaaatttaatcctttaagatattgggtttcccaaaagtcctagtttgaattattttatatacaaattatacaggaaacaagtcaaatctaaaatgatatttgactttatctgggctgtatttatataaatatgttattggtatgtgttccaaaattatgggaaattcctataattctgatatgacttagtatacattatcagtaattataattgttatgttaaattattgtgtgccacagaagtaacaaatttccttgtcaattgtatgtcagctatgactgacctaaaactttgtcatccacagacaattgttgtttgctttggtcctctttagaaggtggctttataaacaaccataaagctctaacagatcctcttgaatacaaatttctgataactttggagactgtgacatcagaatagaagaaaaatgtttaagattcatggaaaacggaaatgtttataaatagtgacctaatagaagactgaaataatctttttgacttctgacttaaaactttattgctgatcctttgttttgtttttttcatagtcaaggaaacttttcctttgagctattgacaacttttaacaatttagtatatgcctatgaacaaactttaaaacatatttgtttctctctatctgacttctccagaatttacaaactatttatgagtattcttaacttttgaaaatacagttatttacaaaagtacagtaagaatctattttcatttataacaggacacgactagagaaactggttattttaccaagacttttgactggaatggtgtgctttcctttaaagaatcacacttgacttatggagccaataaaagccccttaggaaaactggcctcataccttgttgacacagtccctgtacaggtcttcagccaggctgacttatgataagtaaagaatgtcactttctgacaggcccaggagccccaagtttatcttggaacctcaagaggagaagaattcactcaactcataggtatttgatggtacaaatccatgactgggcttggcttttaaaaactcttatctaagtttctttctatggaacaaagttccatcaaagccaatttaaaagcctatgttaaaaaatttttcttgctatactatatgcaaataatcaggccaagtataataaaacaaatcagtcctaccatgatttgtctttaataaaaatggtaaactagacagagaaaaattatatttcaaaaactatggtacacctgttattagattctagtcttgcctaatgttgttcgatttttattattttctacagttcagaccaaattctaatttttcttggctacaagtcttcaaaataatgttttcaattttttcttcccccacatctttcccagtttagagtcactgaaaactaagctgtgctttcataaaaccctacgaactgaaactagacaacttaaacttcagaagaaaataatagcaacctatttacatacataagccactttcatacctgcctactaaagtatggacttcagagtaatatggcctataccaattttccaatattgttcttttgtttttgtttttctcccttcctccccctactttatcttcataggacatgagacttcacaacttactaaaaatgaactttcctagtaactcaagacctacccatctaaaaataaaccatcctagccatgaaacatcagacaaaacctgagagcagattaattttctcctaaaatgttttctccaaaagattttaaaaaagaaaaggggggatgtgaaatgaaaataaaccttgggacccccaaaatcactaaagggaaaagccaaactgagaactgcttaggacaaacctgattctattcaaagtcactgctctactcactgagatatatacatatctgattgcctcatttggagaggctaatcagaaactcaatagaatacaaccatttgtctcctatctacctatgacctggaagcccctccccactttgagttgtcctgccttcgactcaagttgtctcacctttccagactgaaccagtatatatcttaaacatattgattgatgtctcatgtctccctaaaatatataaaaccacactgtgcccctaacaccttggacccatgtcatcagaacctcctgagactgtgtcacggacacacatcctcaaccttgacaaaataaactttctaagctaactgagacctatctcagatttttggggtccacagtacctatcagcagtttcttgggatgagaaagaagagagggacgggaatttggagctggtgagaaagataaccgttgtttggataacacagactaattccagtcacttcaacctttgtgacttggtttttcctaacagaagtggagttaacgtccaacaccatctgaagatggaaaacacttagtttagaatgtgctttcccactttatatttcacattaagtaagcattttactttgacatttctcaatcttcagcctctctttcttcctgttacttctttgtggtcttcagccaggctggaaaacttggtcttcctcggatgtgtccctgtgttttccagcctccaccccactgttcatctgtcacttctacctaccatgctgacactcaacagcactcttcagatcctatccatcctgtaaggctcctccccaagtgccagctcccttatctgtgttccacacacacttactaagttcctcctcccactgagaacattggcactctctgccgtcaggccctgtatcacatgttgctacatgtcattagtgtccttgtttaatgttagagagacaaccagagtagtaaaaataagctgttctgagaatcatttacccaacgctctaatcctagctccacttggacatgagacatatggagcaagtcatattttcacactgctctcagcttcttgttgctgtgtgtgtgtgtgtgtgtgtgtgtgtgtgtgtgtgtaagacagagagagaggggagggagggaagaagggggagatgggggatgagagggagagggaggagagagggaggcttgaggtgagattcaaaaagttttcctggttctaataattgagaaatacttcctcctcaacactctcccaccgcaggattgtgagtccctttacaataaagtctgcatcattttcatctgagttcccacagcaaacaaggcttgcacttagaccacttagacactcaatacatttatccaaccaatatcttgttttatccttacagtgccctgagacagtgactccagccacagacccaagccttgggaggtacaaggtggcctgccaggcccacacagttaagaacaagccaaagaaagactaattagaggagaatgtccagggaatgcacaaaggactacttaatgcaagtactcccatagagggtcctaccagccctacaggctctagagcaggggttctccactgggggtaatcttgccctccagaggacattcagcaatgcctgaacatttttggttgtcacaactgggagggagggagcaactggcatgtagcagatagaggccgtagaggctgcttaacatcctacaatgcacagaaccccacaacaaagagttaaccagccccaacatgtcaacagggctatggttgagaagctctgttctatatatcctcactacacatcatgcaccttctctcctctcccatctttccttaatctcattttcccctttgtttcccaagataagcaacagattctagatgatattaccggaatatgggagctgtggtatgacacacgtgaacactcaaacttacttccttgtcatgaaggcgtaaaattcagtcaagatttcagaaaatctccttacatcttttgaatcttcccagcttttgagggggaagattttcctgattgttttctaccaatttcttatgccacggggtgaagttgggtgggcaggaggaaggaaccagggtgcctacccctcctaagtaatattagaaatacagagcatcatttgacgaaaactgatctatgccactcttcaaagttacaaaacagactaggtggcaaatatccgctttacaagaaaaggagagggcgtttaagaatcagtttaggccaggcgcagtggctcatgtctataattccaacactttgggaggccaacataggaggattgcttgagcccaggagttcaagaccagcctgggaaacgtagtgagaccctatctaaaaaaaataaaaacccactaaaacagacaagcaaattagctaggcatggtggcgtgggcttatagtctcatctacttgggaggttgaggtggaagaatcatttgagcccaggagatggaggctgcagtgagctatgattgcaacaatgcactatagtctgggtgacagagcaagaccccatctcaaaaaaaaggaaaaagaatcagtttacagatttacagattgcctgtcaacagatacgagagcgagagagacattcattaagagctcaggtgttcagagctgctgccaacagaaagaaaacgaagcgagagaagacagcagccattagcagatccaatttagaaaagctgttggcacataacttttcaggaacactatgtgtgaaggactcctgtatcacagtaagttgaagtcaagatgatacccagggccgctaacatgatacctctcttggccattctaagcttctacaaagagtgcaccaactcacttgctttaggattttcc

SEQ ID NO: 506 - DNA, 22391 bp, Homo sapiens
tttggaaacgtacctgatagctgcagcctctactatgtttcaaatgacaaacttcttaatagccttgtacttggccatgcatcgggcacagttcctgccacaaataggctgtacgtggctatggccttttttggcatgaccattattccttcttttcttttgcgttttggaagcaagggcccaggagagtttctgagaagtaacatgatcagagttcctcttcaggaaaaaacaatgtccaactgctgaacaactagacagagtaattaactcactctggcaaagaataacatcctttattatgggatactatgggctgaattgtgttccccgaactcatgttgaagctctaatcccactatctctgcatgtgctcctgtttgcagatggggcctctaaagatgtgattacgttaaaatgaagccttcagggtgagcccccatccaatctgactgaggtctttataagaagaggaaacctggacatacaaagagacaacagagacacaagcacagtggaaagatcttgtgaagaggcagctagagagtggccatcgacaagccaaggagaggggcctcggaagaaactaaacctgccaaaacctgatcttggacttccagcctccagaactataagaagataaatttctattgttcgagccacccagactgtggtatgtttgttatggcagccttagcaaactaatacagatgagctcagttagacagcagttgcagtagtcagggttagaactagacaagctgcagcaagattgcagtgaccggcacaagtgtgaatgtgctgcagaaatgaaatggacagggcctgagaagagaagtgaggagtggggaaaacgacatagtagaaattcactctaacacctgggcctggttggcaaggaagatggtgataccatttgaaaatacaggagagtcaataaaggaaagaggagtttaatttttagacacttttccggacgtgtcttgctacatgctttcttggtatctctttatctatcttggtctttattccctcacatagtagacactcagaaaattattgattaatggacaatctcactcaatgaagaaaattaaacccaagcccatctgcttttgttgttgttgttgttgttttaaaatcttacaccacatgtccttaaatactgaaaagataccctcgattttttctggaagagcctaactatactttgaaaacatccttttagttatctttatgacagtggtcccataagactataatgtcatatttttactgtaccttttcaatgtttagatatgcttaaatacacaaataccactgtgttacatgatcatgtgtcacttaactatggggatacattctgagaaatgcatccttaggtaatttcatcattgtgtgaacatcatagagtgtacttacacaatcctagatgatggtatagcttattgctcccgggctgcaaacctgtacagcacattactgtactgaatactgtaggtaactgtaacatggtgctaagtatttgtgttacctaaacatagaaaagatacagttaaaatacagtattataatcctatgggaccaccatcatacatgaggtctgcaattaaccgaaacatcatgatgcagtgcatggctgtatggtattcattcttaattacatgctacgctatttttgtatatgccactcaaaaatcttaagaagcccttaaatactaaagaagaattgtctcatactaaatcatgacagaagtctttcctaaacaaaggagagtggaatagacgaaggggcagaggaatagatggcacacacttcaactttgctggacatggcaaagcctctgaaagagtttaaattatttgcttaaatcattatttctgttcaaatttctgctagtttgtccatgcggaattctggccatgaacttgtattctaaacactaagaagtctagaatgcacaatcaccagttgttatggacaaagagatcatgttttgaaaagccaataggaaaaaaactattttcttacttgtcaaatgaagataacaacacctgcttcataagtttgtatttaagattaaacagatattatttataaagctggcatagagcatgttctcaaaaatttcactcactcattcattcaataagtacttggtaaatatcagggtcctaggaacatagtgcagtggtaaaggccaaacacctgacccttcctctaccacagagcaaagggactctgcctagtcaccatggcagtctccctcattgtctggacagagctggacagatcccatgaatacttcagggctttcataccaccctccaaaaaataatctatgtctcacttttctcatcctttaacagctgagggtgtctctgtaattcgttatttttcaatccaacaccttctgtctatgtctttatacattagtacactcaattaaaacagttaacaaaattatcttcccaatctcacttcaattatactcccattactgagttcagagtaatgtagatatatataaatatgtaaggagaactaacacttagaaacacattcaaaatagaatatttctcttttcacttagctttttttaaataaatgccttaccccaaagaagataaggaaataatgttaataagtcttacatttaaaggtaaaatatgactcggagaaaagcttagatgaaaagttaacagaagaggacccacaatgcaaaatgcaagatgataccatcccagaatcagaatttccaaaatcaaagggacctttttctcttgagtccccatccaattcaagtagtcatccagccagtgagtaaatgacacctctccccaacacacaaacacacacaccccatctccaaatgagccaacactagaaatagctataagacgaaaggtcaaatgacacttggtagaataaaaaaaaaatctaggcaagaaaagtaacataattaatagaaaaagtaagaatacatgaagacatgcagcaagtattggattaaaagatatatagcaggcagtagaaagattatttgcatttctaattcaaaagcaaagtgtttatcaagtgatatgtttccaaaagtaattttttaaatggaagcattatttgaccgttttaatctcttccatttcctattgatgtaaggccacctaaaaacttatgaattgttttctatttacaaaatgattcagcttagaaaggagtagaatgagactggtcattcagtaatttctcccacccacccttgcagacatcacatcacaaagactgtgactcactttgtcatacaatttctatcctcttaagagtttttcagattgttgtgatgaatactgggtcataaatctgaataaattttcagatgaaactatccatgccatttcatcacagcccaaaatattaacaatggtaccagacagtccccaatactaacttttacaatgattcactggttttagacctgagtaagagagagacacactgacgtaaggattgaagtgtctgaatcaggtatgaattcccaggtctgcgttccttaattagagtactataaccagttctagaactgagcattaatgttggctagaaatattaatatgttacttaacagctgaaaagtttccaaaataaaaagtgatccaacaaatgactacgctttgcctttattgcttcccttgaataatgttaaaggtgtttgcagaaaagaactacagtgctgttgcattcaatttaccattttatatgcctcatactatagtatttatacttatttgaagttgttgcccattcaacaaatatagagtgaaccttttcatgggactcagactggtcactcattcagcaatgaagccaaaaggaccctgggatgagtaaattcagcctcagaccctcagaataggaaagagtaaagaactactgggtaatgtggtctggattttttaaaaataaaaatttcttgccagctaggaatttccagtaaaactgggggacataaaattaaaatacaacaagctattagagagaatttttagatagcacacagaaaaggaaagatggatacaggatgatgtgaaagaaataaggcccaaagcatgactggaaatgggataaggtacgaggacagacaggacatttcagcttaaggaaaactgcctggttaaaggctaagatgacaaggaagacaggagacgtgaagggaaggtcagaaaggaagttaagagacttggctaatttattgagtacatcttcaatttaacaaacattctttgagtggccactgtgtgtgaggatagatgcagcaaatgggatccagtgcttgcctacaaagagttcacagtcccagtgcagaagccagacacataaaccactaactattacagaaagcatgaagttctgtgttcagactatgtaccaagtatatgggaaaacagtaaaaaccattaattctccctgggaaggtagaggaaagtttcacaaagaagtctgttgggctggatcttaaaggatttttccagagaaaggtgaggatgggaggagttgtgagagagaaattgataagaaaaagaaggatttttcaaaaacaagagtcacatgaagaaaggccaatcattgtgacagtaatcgttatgacacattaaagagactataattaaagcacagagtgctacagcttcaggaaggtatggatggtaaacagtaagaaataaggtaggtcatgtttaagaaggaaagccaggtaggtctggttagtgcttaaaattgcaggagagtagaggtcattaaatcaagaggcagggcaaggaaatcactatggctgggaaacattttagagagatatatacgaaagaagtagagaaaggcatcaaagacaattccatggtgtctagctttggagacaagaataataattcactacaagcagaaattcaggaggaaagggtgctagtttgagaaaatggtgttaagttctgttttatgtatgttaagttgaagctatggcagtgtgtctgccctccaagcagtgggaaattgagatggggaatcaagacagagacagagacaatacatgatcttctgaaggaatacaagtacacagaaagaagagtagaaggctaaaaacagaaccttgggggaatacaaatgcaaaaaaaaaacagaagaaagtggaaaaaaagacagttggatgggcaaaagtataaccgcctgaggagttcttccagcctgctgcacaaggaaagaccacagcattgcagtaaagaaagagtttaataaacacaaggccggcaaagccacatgggagatagagttagtactcaaaccaatctcatccacagctcatgggataggagtttttcaacagcagtttgggggaaagggtgaggattgctatgcaatgggtgcttactgataattcattgggctgaagatgaaataatagggggtcaaagttgtcctcttgagtggaaccattcctgggtggggccacaggagtggtttagcaggtccagctggagccatgggtgtcagacatgcaaaaaacctgaaaagatatctcaaaaggccaatctacaatagtggtgttatctgcaccactattggtgcactagtggcaatctattaatacgtctacaccttagcacaactcagattcctgtcctcccctgaagcctgagggcctttcattagctttataaaggcagttgagttttggggaaggcttattatcctttaaactatctcccaaagttatctgggcctaagcccagaaatgattaaggcagcttgaaagctaaaggcaagaggaggggagtgggctaggtcatatctctggcagtgtcataattttctcagatataacttttgcaaaggcagtttcaaaaggagaaccaggttgatgtgatgtaatagaagccaaggaattatcaagaagtcagaggcagacaatactgccacatgtcagagtagcatgaaaaattggaaaaggccacatgattaaattagaagactactggtgctctcataagaatgatttaagtggaatactgagggcagaatctagaatttaaaagagttcaaaaaaagaaaaggagatgatgtagaagaacgtactgattccaggatattattcacaaaagaaaataagaatgaaaaacaatgcacagcatacctgagaaagttttatattgcatagtgagacaggacagccaagtataaaggggtccctggagaacctccaaatggcctgcacactgggagaatggggtggagccacagaagttcacgccctttgcagggaggagactggtctctcctgttcggggtggtaacttgggaatcaatctgtgagatgggggcctgttaatatgaacccctattgctttgctgtgttgtttttccttttttctttctgaccaataaattccataacccctcaccctccaaagtgtctgtgagcctaatctttcctgggcgtgtgacaagaaccaggattttcctacaacaatagtacatgataaaaatcttaaatacttttaaggaaatcagaattcccaataaaagttctaaacaatttttcctgaaaaatgattcatctttctctagattattctaagaaaaactaatagccagtctccaaaattccgaaatgtttcccaaatataactttgctatatataattatcttcatttaaagattgaccaagtatctaaacacagatgtcaagacaccaagaaaactgtaaactttgaccaagctttatacagcatatgcctcatgagtagttatttcacagcaagttccacagagaatgttttcctcatcagctgacatttagtgagcactctctgagtaaaaagtactgagctttttatgatgtttatttatataaagaagtcatggttcctaccttaaggtgccagcatcttaaggtgcctaaattatgaacagagaataatctgttcacagaatgcagccagatcattactactctgtacaaatttcttttaaaaaatacttttttcttggctaatttgagttatcatttaattacaagttttcattataaattaatgtatagcttaattataaattaaaccaggatcattcctttcaattgttcaattatatctggaacatacacttaatattcacatagcttctcttcaatttttaaatctccaaaataccttgaaaatctgtgaacttttcatttcagaattctattggataattcatcttagaggttaaattgcagaagtcaatagctctataaaaatacaaatacacacatacacacacacacacacacacacatccattatacatttctgtaaatgagtaagtatcaaagatacaccggtcaagtcaaaagtcaccttgtgcaggaagagtgacagaagacagctggatgagacataaacactgaatattggctgtctgttgcctccaggcccttccaatttcttcaaactaaaaatattctgaaggtgtttagaatgagactggtctggcttctaagaaccacagtctatggctcaaagggtgagttcccctggaagttgccacttttcttttcctcctctcctaaattcctgtggctatacataacctagcttaaaaggccttgttggcggtcattattaaagggagaaaagagaaagcaggagctaactgaacagtggatacaacaaggaaacacttaaaatcacagtgccataagtgcattttctaatgatccagctaaaactctacactgataatcattattccaaattattatgcaaacaatcaagcattaactatttattgagcactgacaatatacaaattaagtactagaccagatcctaatttcagagcacagaaaaggacaaactcaaaaataaaacagaacaaaatacatttgtttggacagaatatcctgatgaggttaagatttgtgccccaggctgggcacggtggctcacgcctgtaatcacagcactttgggaggctgaggtggacagataacctgaggtctggagttcgagaccagccaggaaaattcatggtgaaatcccgtctctactaaaaatgcaaaaattagctgggtgcggtggcaggtgcttgtaatcacagctgaagcagaagaattgcttgaacccaggaaggagaggttgtagtgagctgagattgtgccactgcactccagcctaggtgacagggtaagactgtgtctcaaaaagaaaaaaagaaaaagatatgtgccccaaagatacagatttgccttgctccgtttcatggtcatagacttttatcccatgccagccttcttacagacgtgtgctacgggacataggggcccaagtagggtatctggaaaatcaacaaacactagaattggaaaaacaagcaaagactacagcacatgtgtaattaccagcttgtacaggcatctcgtggttttaaaatagtagttccaataatgtgagaccttaaattgtcttttcaacatcactgatgatgagttctcagaatcagtgtatagatgaagaaagtcaattttatgcttatgatatttaaagaaccgttcttgttttgttcattacatctgtaacattttattttctaattaaactttaaaattatgtccttccacataaaatggcatcataaatcaaaatgagaatacttaaaacccaattgttacaccattgtcaaagtctaattacataacggtcattttataaacaaatgaaacccctcagggcatgtcatgaggggatattgccttttctaggctgaagtcacttggcatcaaactcatcttaaaaggctcctaaggtgtggtaatatctatgactcatgaattgtcctttcattgctgtactgattacatgatttccaagattaaatgagctattagattctgacttcatttgtttactgcacccaatatttattacagtaaatatcacgttcattaagtaaaattattgctatccacttgccagatattaccaaagagaggtggggggagagaatctagtacgtgtattattaaatcaatggttctatttaccccaaaggcagtagtgaagagatggaaaggtggctttatccaaaaccccaggaaatcaacctgaggcacccgtaaactagtaagaactcttcaaaggggctagcagctcactaccctgaaatggaggaagcctaaccaaagtggggtccagcagggcacactctatggtggaatgaagagcgcactgaggctgagggatggcaggaagagaaggcaagggaccaggtggtaagaagctcattcaggataaaaaaagaggaaacccacaagtgaacttgagtaattggtgacttttctgagcttcagtatcctcttctgtaaaaagagatgggtaaaccagaaggtctgaagcctccctttgatttcacaagtccatgtttttatgcttggggttgcatggaacacatgcagtagcaaagagcccaggggtcaggcccacctacaagccacccctgctccacactggggtgggcaggtctgcctttccaagtctcagcgtcctctggagcctgcaagcaaagaagtgtggcacacaggcagtcacctcctgggagaagcccaagggtagatacagtacttctaactactctcattttttttttttttttttttttttgtaaataagagcacctggaataaattgaatactaagtgtacataagcagcatacatttcacttactatactctaccacatgttgtacgtgctgcttgggataaagtgttctctcttctgaatgtttttacacagcttgctactttagagtacatacttaatattatccattcccaccgcattgaaagaggcctgccaaaagttaaggatgccaaaagaaaggcaggagtgcagcgcacatgctggagaaggagaaactctctaaccacttttaacatcttgtttttatcaagactctcatgtcaaatgaagattattccaggactatgagaaaaacgccagaaaatgggcccttttgagtgcaaattcaggagaatgcccaggtgtgaagcacagttgaccttcagcaacactgaaaaattggaaacatttgtgttgtgtcatcttctcctacctcttcttttagaaaattttcctctctttcctacctcacagcttcccactctgcctcctcttcccctgcacctctccaggaccccatcatttatatcacagtcttcaaagcatccctccccaaactccagtccttctggccagcttttggggaagaaattgcactcacaatttaatccatactaaatgttaaaatctgataatggttgaacttggcctttcaaaagttacctgcagtttagaaaacatgtaggcacaaagtgtcatgccaaaggaaaaaaaattccagtgacagatgttcaggtcagttggacaaaacagtctgaggaatgagaccatagatttttcaacttttcaaacaggtctagaaatctgagccataatgtagtaggaaactgtggctactattaactcttctccatgttttctggtcagttttatttgttttggggggtctcctcatggtttggtcaactatcagtaaacatccaatatgtgagaaaataatatactgtacttaaatttatgtccaggttgggctacatagaaatagatgaaatttgtcatttttagatttgtattcttgtcagtctattgcctggtacaggtatcctttaaaaaaagagtagtctctttggggacttgggaagaaagggtgggaagttggggagggacaggactacaaactggattcagtgtatactgcttgggtgatgggtgcaacaaaatttcacaaatcaccactaaagaacttactcatgtaaccaactaccacctggtccctaaaaccctatagaaataaaaaattttaaaaaaattggtagtctccacaagtctggatgagttattctacatttcccttttaatgtcttgtccttagctagttataaagttagcagagttctcaacctgagtactagtgacatttggggtcaaaaatgtttttgttgagggtattataatgtgtattgtaggatgttcagcagcatccccggcctctacctgccagatgccagtagcacccttccaggttacagcaaccaaaaatgtctccaggcattgtcaaatgtcccctgggaggcaaaatcgtccccatttgagaaccacagagttaaagtaagattacaaaaatgaaaacccaactcacagttaggaagaaaaagttaacggttgtttttacaacggtggtaatgtggtatgcaattcaaaattatgtccactggctaacctctacatagttttattctaaggcgaatcgggtatcaaaatcttcaaagaaaaaatgattcagcaactaatagagtctgaaaaaaaaagagtattaggggaagccccaaatattaatttaatttaaagggaaattcttctgtcttctggtcataatacatgctttttaataaataatttgtgatactagaaagaacaaaaccaattgggacacacagcaccttgcccttgtcagctgagatggcgtagcagacaactgcagaacaaacttcaatcacaaagataattttttgaaatagatgagttcaagttaccagaatagagaactagcactaacccatctaataggttacaagcatcttttcagttttacgggattaagtgattgataaaatttttaaattatggcaagcctgaaaaaaattaaatacttgcctctcttgcaggttgctattttggaagcaataaagactcagctcatatgaaagtgtattgcccattcttctgccaattcacgtttggttgtagaattttcttctcttccagcccccctccacctcccctcatgacatcccattagcatcccaagacaaaggcagaactacaggggagtggcgctgggacccctgtgggtcttttctcaggcaatgagagaatcagattctccacctggaacccataaaggaaggaacgccataacacacagcttttaaaacacatgtttacatacacttacaggaggacaggttacaatatattctagtcctctttctctcacttcaaattccatcagtgttgtaaatcggctcatcttatgcccctttctttctctttcctctagaccagtggctctcaaagtgtgatgtgatcagcatccccggggaacatgttagaaatgcaaatcttcagcccccactccagacttagggaatcccctaaagtccaagcactccttatttaggccagtgttctttctagaaccacaaacattgtttcttacagaaagcaaaactgcaattctcatttcatcctcaagcctgctgcaaggtagtaatatattagccccacgtgagcgatgaggaaaccggctctggggttaagcgtcggctcaaggtctcaaagctagtcactgcaggtggaagattaaagtgtttgcacttcttttcactactgaaacaaagctatggcactttattaacaacatctggattttttgctggttggctggttggtttttgtttttgctctttcagctttcgtcaattcggaaaaatataaaacagagtgggtgagagtagtgtgccatatgcctcgggtcgtcccgagtcggaatttaagggcaggactctagaaaggtgtttttccagtaaagaccgtttcgttctgctgcggtccttcctgtctttgtccccgggacagcacgcagcagatagaagcggccagagctgcatggcggggccgcgggcatccccgacgcgacaggttgtccgcgggaagacagccagtccgcgaggccccggcgcgccgcggctccgggccgggggtactggtttacagggcaaattggcacaccccaaagcccaggggacacccgggcctacgccgcagcccggaaaggagggggtgagtggtgaacccgaaaccgccgagggccgcgcggccagaaaccacacggagcgctagggtcgcagtgaagatccgggaggagggtgcaggctggaggggagagagcgggcgagaacccacgaaatggaaatgaggcggagagagcgggtcggcactcactgtgagggtcgctcttctcccggaccccgtcaactcggccgtcggggtggatgcgcaggaagaagcccccgtttttgcagtacagccgcttggggtccttgaagtggccgggcgggaaggcgccgctgccgccatcctcgggcaaggcgggcagcgtggtgatgctcccggctgccatggtccctgcggggcccggccgggatccccgagccgctggagccgcgcggggagccgccgtcccccggccccggccccggcctccgacccgctccggggcacggccccggccccggccccccagcctcccgcccggcagcgcgcggccgcgcccgcggtcccccagcctcgagccgctcggccgctcttctgtccgccggcccctggtgcgcggcgagccggcggcccgggacctggggttcacggatgggtgtctccgcggacgccgcctggggagagccgcctcccaagctgcagcgcccgggatcccgttgcaaccgcgggcaccgcgtccgctaatctggcacccgccgggccgcggcgtcacatcttctacatctccaccccccacacccaccagcctcccgcgcccccagttctcctccctcctgcgcgccgccccctactcgctcgggttttctggggccggcctctgagttcggcggttcggccacaacacgcaagcgcgcgacatcagtccggcggggagcccggcctcagtcgggggcgggggagaggcgaggggcggggggcgcgcgtcggaggccgcggcagggctttggcattccctgggctccaccgccccttatcccccaaaagtcacccccgcccaacccccgcaccacccaaaccacgtttaggctttctccacactgcggggcttttgctgcgcaaccagccgtgactcaacttttaaaagtttaaactcaactttctcccccattttttccccgctagcgtttcaaaacggagaagccgtttccaccccaaagtagagaagttgcaatccaaggaagagtctgtgtcagagcaggctttgaaaatctctaaatcaccaaaagacgaggggtacaagtggggcataaactttaaaattaaaggacagaggctgaagtcgtctaccaacaaaaggagagaaagaggccagagaaggggagcagattgggttgctaaaacgaaaaggtttcctttactgacctatcttgaattagacgacgcagaaagatgaggatggggataaggataaatccttatcgcgatcgaagcgcattaatgtcttaactcggacctggcatttgccctagctaaattgttatgcatttcttggagagagagttattttctgtaaatcccaaatgtaaaattgaagttaattgcattttggtaattttcagtaggatatagcaggtgccacagatgactaggaaaatatctattcagaaaacttgcatgtattgagtacctactgtgtgcaacacataatgttgagtgtgtgggagatgccaaatctgatgccagcgtctcacacactgagggagataagatgggtagcatgagtaacacaaatagcagtagaaagtaggccatagaagagtaagactaagtgctgtgacatttcagacatcggataactcagcgtggggaggcaggagatttggggaagcttctagaaggagttgcaagtatggacgtgcctccttgtagaaacattaggtttcaaaaggccatgcataagtgcatttgttcttaagtctccaagaaggctttaactccagatgcatttctagaatgttacatacaggagaatgagtaaattctttgaagctttaaaaccaggcatactgtttttatttttattatttatttattttttttagacagagttttgctcttgttgcccaggctggagatcaatggcacgatctcggctcaccgcaacctccacctcctgggttcaagcgattctcctacttcagcctaccgaatagctgggattacaggcatgcgccaccaccacgcagggctaattttttgtatttttagtagagacggggtttctccatgttggtcaggctggtctcgaactcccaacctcaggtgatctgcccgcctcagcctcccatagtactgggattacaggcgtgagccaccgcgccaggcccaaaaccaggcatattcttctttcttcttgcagttggtatatgttctatagaggaggaaaaaaaaaatttccccattcattactaggtttatggctgaagcccctgtaacaaaagacacattaacaagagaaaaacatactaacttatttatgtgagttttacacaaaacaggagacttcagaaattaagacccaaagttaagagggaagcctgtgtatttttaaggctaggattgataaagaagtggaagtcatggagaagtatgattggacaaatctgtgatctaatggtaataaactggggggacttacttagcaaggcctatttgctcagattcttttccctgtccgtgtgtcttcagagataaggatgtctgtttcctccaggtatagggaaggcacctctggaatgaaggtcttatggtctgcctcagaagagaagatctggggaaagtgaaagtaaccctcttgcttctgctcttttcttaagtgccaaggtaccattatttttgggtagcatgtcctgaacgccatcagttctctaacatctctctccaaaatggatttgtttcatcttcattgaagatccgtctgttgagacaaaatcactccctccagatgatctctgtaggtgctactgtggtgctgagtagtccctagaatgattgaactctcacttgaactctgtgtcacagaaacctgaggattccaggagcacggggataaaatctaagtcatgatattttttaacaatggcatccagaaacctggggagcagctacacgcagtaaaataacttgtattccctacaattcaaacaaataatctaattttcaaatgggaaaagatttgaacagacacttctccaaagaaaatatacaaatagccaataaacacatgacaaggggctcaacatcattagacattagagaaatacaaatcaaaacaacaatgagatactactttacacccactaggatagctataattaagaaataacaacaacaaaaaataataagtgttgaagatgtggtaaaagtggaaccctcaaacattgctggtggaaaggtaaaatgatgtagtcaatataaaaacagtctgacagttaactctaaaattaaacagagtcaccagacaacccagcaattccactcctaggtatgtagccaagagaattggaaacatatattcacatgaaaacatgtacataaatgttcatagcagctttattcataataaccaaaatgtggaaacaagccagatgtccatcaaatgatgaatggataaatcaattgtggtatatccatacaatgaaatgttatttggcaataaacagaaatgaattactgatacgtgctacaacatggatgaagcttggaaacattatgctcagtggaaaaagacagaaaaggccaggtgttatatgattccatttatatgagatgcctagggtaggcaaatccatagaaacagaaagcagcttagtggttgccagggctgaaggagagggaaatgggcagtgactgctaatgagtatgggatttcctttgggacctataaaagagttccggaattagatagtggtgatggttattacacaactttgtgaatatactgaaaaccattgaattgaacactttaaaatggtgaatttcatgatacatgaattgtatcttcaaaaaaagagaaagaaaaataatagatgtcaaaatgaaaatgagtttttttctcccataaagtcgggaggaaaaagatatcatccagtgctattaaggatgaggtgaaccaaagaccttatcgacagtcagagggaggctaaattatacagcattttgggaaaactattttaaaaggtacatcacagttttaatttttgattttttttcttttttgagacagggtctcgctctgtcaacccaagctggtgtgcattggcagaatcgtgggtcactgtaacctcgacctcctgggctcaggtggtcctcctacctcagcctcccaggtttgctgggactacaggcgcatgccaccatgcctggctaatcttttgtatattttatagagacaggtttcaccatgttgcccaggttggtctcaaactcctggggtcatgcgatctgccagtctcagcatgccaaagtgctgggattacaggcatgtgtcaccatgactggcccaatttttgaaatttaaataaccatttgaggcaacagttttgatgtaagaaatttattctcaagaaacgattatagatgtacacaagatttattaacctggatgttcattatatccttgatcataatgaggaaaaataagggataatctaggtgattaatgtgaataaattacattatattcattcgaagtagtacgttccatgtagccaaataaacagttttgtgggagaatatataataacatgaaaaaaattcttgcaatattgtatattgttaattgaaagaagtaggttacaaaactgtataatagtatctcatttatttaatatgctttcatacacataatagaatgagaaacactaaagtatttgtagtgatattttggaaggtagaattttttatgcaaacaactaattactcactatcacataaacttatcatctaaaattgtatcttgtttgtttttgtatttattatcagtttccttcccctaatataatacaagaaaacttagagcagagatctttctgacctgtacattgctgtatcccaaggacctaatggcactaagtggggcctcagtaagttggtttgcttgtttgtttcttttttgacaaatgaaggaatgcattattttcatcaccgaaaactgtttttgaaagctaagttcatcatctacattatggaagggcaggtatcagtgtagtcaatgtctgtggaagtctttcttttaaccatttcataatgaaaatcacattaaacccatttccttatgaaaatctcacaaaaaatgcacaaattactgttttctaaaacctagtacatcaaaaataatcttattagttctccagatcatcatcatactatcaggtatgaaataatagagtgaaccactctattttatcttcacaagaggtagtaaagattactgtctaacttttgtgctcagatgacagattctaatgtcacctaattgtgctttagcacagaaaattatttaggtgacttgtgtccttgacttttaaaaacaaataaacaataacaaacatacaaaacttccagaaatatccaatggcttttgttgcatttggctattttatttttaaatattgtattgtcactcgaatagatcaccacgcttcaattatttattgttctcagaaggtgagtggcctcctgctgtgcatattaccactggaatggcaattccatctcctgtcagatcagcagtggtattaaatactcacaggaggctgggcgcagtggctcacacctgtaaactcagcactttggaaggccaagcggggcgaatcatctgaggtcaggagttcgagaccagcctggccaacatggtgaaaccctgtctctactaaaaatacaaaaattagccaggcgtggtggcgcactcctgtaatccagctactctggaagttaagatgggagaatctcttgaactcaggaggtagaatggcccgagaccatgccactacattctagcctgggcaacagagtaagactccatctcaaaaaaaaaatactcataggagcattaaccttattgtcaactgcacatgtgagggatgtaggttacgcactccctatgagaatctaatgcctgattatctgaagtggagctgaggcagagatactggtgctggggagtggctgcaaatacagattaacattggcagagagatttggctgcacagagaccataataaatcaattgcatgcagactcataccaaaaccctatcagtgagtggcaagggacaagctgcatctggtggcaggctttaagtcagactctgaaacttattttagtccatgcatggccttcccattattttatttaccactttggtccttgcctctttcctgcactgcatacttgtctcaggcacagttttggtaaacccacaggctaaccctagccaaaatgagtgaaaaacaaacgtcactggaaaggttctttgaaaagggggaaagaccgagtgatgtgacagcagaaggctctaagactgccaacagaaagaaagctgcatttaaaagaaaataccaagagtctgacttaaattacaagctcattgcaacagggtattgacattctctgagcccactttgtataatatgtggtgactggctatccaacgaagccacgtaaccggtaaccttaaaaactgcttcgtgacatggagaccaagcattaaaagacaagtctttggagtttttttaaaaaagaaagcaatgtgaaggctgaggcgggtggatcacctgaggtcaggagttcaagatcagcctggccaacatggagaaaccccgtctctactaaaaatacaaaaattagttgggcatggtgacaggcacctgtaatcccagctactcaggaggctgaggcaggagaacttcttgaacccaggaggcagaggttccagtgagctcagatgacgccactgcactccagcctgggcaacagagcaagactccgtctaaaaaaaaaaaaaagaaagaaaaaaaaagaaaacaatgtgaacatgaacagaagcaattttcgaaggccaccacgtcatcaaatgtgtctccactgagagcttcattagtggctaactgcattgctaaagctaagaagccctttactattggtgaagagttgaccctgcctgctctaaggatatttgctgtgaacttttaggagaggctgcagttcaaaaggcggcacatgttcttcttttggctagcaccataactagacgaaatgataaaatagcagacgatattgcgtcacaattttagagaggattaatgagtcactgtggtacacaatccaggttgatgactccagagatattgacaacaggggacaatgccatgtttttcaagaggatgtgcatgaagatatgttgtatgcacttttgttgccaaccaacaccatggctgcagaactattaaagtctttgaatgattacatatcgggaaaactgcattggtcattttgtgccagcatatgtatggatggagtggctgccatgactgaatagctttctgatttcactacttgggtcaaagatgtcactccgaatgtgagtgtgtcacattcagaagacactgtgtcatccatacagaaatgctggctagtcaaaaactgtcacctgaacttaacaacattttgcaggatgttgataaaattatcaaccacattaaaatacatacccttaactcacatccgttcacacagctctgtgaggagatggacacagagcacacaagtcttctcttatacacagaagtgagatggctttctaaaagtagatcactggccagagtttttgagttacaagagccgctgcaggcatttagaaaaaagtcaccactggcagcacattttagtgccacagaatgggtcacaaaacttgattacttttgtgacatattcagcctgcttaatgaactcaatctgtcactccaagacagaacaacaacttcaagttgtaaggtaaagtggctgcattcaaagccaaactagggctgggcacagtggctcacgcctgtaatcccagcactttgggaggctgaggcgggcagatcactagaggtcaggagttcgagaccagcctgagcaacatggcgaaaacccgtctagactaaaaataaaaaattagccgggcgtggtggtatgcacctgtagtcccatctattcgggaggctgaggcaagagaattgctcgaacttgggagggtgagattgcagtgagccgagattatgccactgcactccagcctgggtgacagagtgaaactacgtctggaaaaaaaaaaaaaaaaagccaaactggaattatgtgggcaacagtgaacattgggatttctgacatgtttcagacattagcagaaatttggaaagagactgagccagggccttctttctcccagctggtgcatgatcacctatctcggatttcaaaagactttgagcattacttcccaatcacaaaagacccctgaactgggaaggaaaggatctgccacccatttgtggataagccaggggaatcgactttgtccatgctggaagaggatcagctgctggagatggcaaatgaccgtggccttaaaagtatgtttgatctgacttcaaatctccatacgttctggactaaagtcacggcgaaatatcctgaggttgtcacaaaagcaatgaaaagcctgcttccatttccatcatgccatctttgtgaaatagagttttctgcagtgacagcaaccaaaatgagattacagagtagactggacataaacaacacatttcaggtgtcactctctcctgtcatccctaaatgggaccatctagttgcatgaaaacaagctcagggttcccactggttctacattatggtaagttgtatatttattttattatatattacaatgcaataataatagaaataaactgcacagtaaatgtaatgcacttgaatcatcctgaaactatcccccaccccaccccctgccccatgctatccatggaaaaattgtcttccacaaaaccggtcccctgtgtcaaaaaggttggggactgctgatctatgtgactataataatcaagtgactagtctcagctcatagactgattttgccttcccaagatcaaaccctaagttcagaaaagtgagaaaaatgaaaacttcatgatgtcttttactcttaaatcatctttgcagcttcctagagggccattaggtaaccacaaatacttgggtttttaaactttctttctttctttctttctttttgagatggagtcttactctgttgtccaggctggaatagagtggcatgatctcggctcactgcaacctctgcctcccaggttcaaatgatccttctgcctcagcccccctagtag

SEQ ID NO: 507 - DNA, 2380 bp, Homo sapiens
attgcctataaaataatttcccatgataaatatctatatatcccatatgtaatactactttaaagctaatagtatctacaaacatattgactggttttagactggccagacttactgaggtgcaaagtactcaccttctaactactgttgaaggaaaatctatttggtcaacatcatcaggcaccatatttcagctccgtgcaattttcaaaattgattttattcttcattttataaaaattgcatccagtgcttgctagcctaagggtgcttttacagtgactctatacactagaaaaataaccaatgttttgttctggtaaagttgaataaaaagatgtatcatctaactctacttctgtaaaaccagcagttcatttcttttggatgcaagggatgaggagctttcagaggggaagatgctctgggctcagagccgtgtgacacctcaggatcctgcccagtagggagacagtgcagggaggagtaaagtcctgagtgccagccttggggacccacagggattctgtccccaacctatcccaaagcccaatttcctgtggaataatttccttttcaggataaatatatattatttcaggtttcaggcagatcttggaggaaaggagcaaatcctcactgcctctgttgctgtttttaagctgcagccagaaagctcctattgagcaactcaggttccttccatgtggggacgattggacagtggtggtgttaggtgcgttggaacgtgactacaattggaattgatttcttgacaacacactgcctgtgtcccattcgtgcagatagtcttttagcagtgccggtctgctgtcagcttgtagtacctgaattatttggattttgattattcgggggaagttgttattcccaaactggtttccttcagcatctcccctggagttactgcatctcagaggatgtaaagtcattttcacattagtttgaatatcccctaaatggaactggtgcctgagttgaactcaagatctgtctactttccagctttcctgggaacatagcacaagtgaaatggttggggccaaagttttgctcagattttaggggctcccaagccttgctggggaaatgacccaggaataaaaattgtgggcaccaaaacaggaccctggacccctagttctgtgttccttgggagaacacacccgtgatgtttgtgggtccatttcagagcctctgcagatccctgtattcttgccagcagcagtggaggttctgcattgttctagctttctcctgacactcttgaggggggggtcgtgtttcctgtgccagcctcacaccaccagttaacttctgtttgttttctccactgacgaggcctctctcaatgagtaatttttctgttcacaggagcactcgctgaaagattattgcagcggcttcttgtttctgtgaaaagcagaaggggcaccgattcccgtgaacccacccaagccaccgccccactgaacattccagtccttagccttgccctgacgcctgctttctggctgagagccatcactgtcctgggcctctttgcttcattgccatccccagcactagcatttggtgttattttcagggccatttttttttttacatagctgttgtatttgagttttgtttttctcactttataagaatgaccaaatccacaggaataataaagcagcagtgcctgcgttgatacgcaggtgatgagcctcctccagcgtctgcacaaatgctcagcagctgctcaccccagcacccccgccgcaaaggggacggatgcaattccagtgtgcgcctctgcaaaatgacacactgtgacgtgggagagccttgtccagtggaaacccctgtggttccgtctgcagatgtagagcctttgtatagtcagcagctcccatcacaggcatgacctgctcaattaggtaggacttaccctattagaggaattagaatgcaataataaataaaatacaatatgctcaattggtatgagaaataacaagatttgtcttgttcaggactgtgcagtgtccaggtctgggtgtgctcgcaggaccttttctggggcagcagtagcgtggggaggggatgcagaggcaaggcagggggcaggagaggggcagaggagctctggccgccctccatccccggagcccagtatggcctgtgcagtgggcgtgcagctgtcttccttcctggtctgggaacaggtgtgtgtcatgccacagctgaatgccacgtggcctaggtgtacactggcaaaggcagaaagtaaacctgccattttctccttctgatttcaaagttaatttccttgcaacatttttaatatgttaagaacctttgaacagctggcagc

SEQ ID NO: 508 - DNA, 2246 bp, Homo sapiens
gagccaaagatttggacaaaaatgtgggctcacccagattagcagtgctagacactggcaaattaagtttcaacatttatagttcatcttggcagctactcatgtcctgatgtcatgcagccatgatgtaagcgagaaagagtgatgttttgcaatagacggattttggtaacccttcccatgagtgtaggtagtaggataccaatatttatatcacttcacagaaagcatgttacattttgtaatgcagagacattaaatggcttcctcatggtcctctgcatagatgaattgtcctcatgtttaacatcaaaagcttaaattgctgatgtttgttattttcttatgacttttttctcaattagatataatgaatggaaatcttgacatcaccaaaacgaacatgttaaaattaaaggattagatttgtattgtgccaggaaagactaaaagatgaactatgttataatttcatccttttcaaactttatgaaaacacaactatacaaaaagctaccttggggaaagagaatataatgacaagcatttttaattactttttttgcaaatttactggctccaggatggctgacattatattctgtgccccatcctcattatactctgaaatgctaaataataaagcactcatgaatactgatgacttaaggatgtgttctcaaataattggaggatagacgaagggaagtgacaaaatggggaatgaaagaaattgatgaacctcttggctggtgtaatgtagtcaaagatgccagaaacatgttggcatttgtttcctaaataatccaccctcaattaatgacacaactgattgatagctgaaagtgtagttctgaagcacaaactttactgaaaggctctttttagggtcttcttacatatagaaaaaaatgaaacaatttccaaatatatttatgcattttcctcttaagttctgcttaggtacttaaacattgacagatgtggttctagctccataggaatgtcagagattccttcctacaaaattaatggtaggaactacaaggatcacaagattgttttatatgaaatatcataaacagatggttatcataagccacactctgagtttccatacaatctcacagggtagattttatgttgttaataagtactattctataggtgaacaaagttgaatctcatgagtatttgttttggttaacattttggttttgcaacctgaggattttaattcttttcctgatgttctaattttaattatattgtgtttataatttataagtatttatagacaacaaatatttataatctttaaggttatcacccctccatactccagcattaatttctttttccttttatcaggaggcaattcttaattaattaaaggcaatcctgtattgtttcttcccatactctccccagctcttttacatctttttgaaatactcaggaagagaaacgctttctaggtgtggtctgtcactggagtcactgggaggaaacttcaactctccactccttggtatgatgtaagctttgcatactgtgtgaaaacattcagaaagtgctgactgcaatccgtttgcattaaattccttctgaaggaaaaacaaaacaagttaaataccttctactcaaaggaaagcagaattttaagtttggtttaggaatgaatgaaaagttataatttaatgtaaatgaaaggcttgttgctggactgccattgcaagaatagtcaagtttgatcctcttttcaccactcatgatcaaaattgtcttgcttatctacatcacaaatggaaaaaaaaagagtccattgttttagattgaatcttaaaaaatgatagctattattactctttaatattttatatttccttcaaaaataaattattattttacaaactaaaccctaaaacatacctaagataatatcgagtagtgtgtttcagggttagaggtggggttgaggtccatctcaacatgctgatgttgaggatctcaccggcaatgcagatttggaaaaacatttccttattccactgtcaagttttagagctaagagggccttgtagaagatgaaacaaaagcacaaataaattaagcgacctgcatatgactgtttgaattaagtggcagaaatataactaagaggaaggatactgatttttttttttttttttgagatggagtttcgctcttgtcacccaggttggagtgcagggttgccatctcgg

SEQ ID NO: 509 - DNA, 6019 bp, Homo sapiens
gttattttaatggtgccttttgcatgtaacgtttatctgcaccgacagtagtggcaggttacaaagggaggcttggggaaagtggctgctttgggataattatgaggcaccatagtgcacgcaccgggctgggtgctgtggaactggagacgggactaataaaagctctgtttacccacctcgagtgaggctgtcaactacagggacctcaccgcgtttaggaaaggctcttgcttgtctggatgtcaggggaatacaaatgtttatgacaatgctgagcagttgcaggaagtttagatggcctgagggcagaaaaagcactatatatatatgtagagagagagagagagagagaagaacacattgaattattgcacgtgaaatgaaagaagggaaaaaccttccccttttcctactcatcctgccccacaacacaacagaacaaaatacctagtgcggtgaataagatagttccagtaagaagaaatggaaaatgttggaagctgacagctgggttcagatgtagggacgctttcagattttatcagcttccagcatgtttaaaggaggggacttctgtgaggcagtcaagcgaaaatacaagcctggctagaagggtgtctagtgtgtgttgcttaagggggtccccgtgatgtatcattgccttggggttttttttgtttttctaccttttttttctgtttttaggaaattactgattttctgggggaaagtaatatatgttgatcataaaaaaatataagtaatgtagaaaaacaaagattctcaggttctaccaccttgaaataactacctttaatatcagatgaacatcatgaaggaagaaggaggaggagggaggaaggaaagatagcaataaagactttcaaaaactgaagttatggtgtacttttttttagtttatttcttattattaattatatagtgtcaagcattttatctggatattttatgtatttattgactttgtattatttatttatttttattttatctggacattttatgaaaagtacatctgtgttgcggcacgcatcagtccttcacgcctttttagggctaaatggggctgctcgtctgccaagccccttcaccattgtacggacacattccattttgtctgtccattcatcagttgatggacatttgagttgtttccacattttggctattaggaataatgcagccttaaacattcatgtacaagtttttgcacacaggctggatgtatacctataggaatggaatttctgggtcatatggtaatgctgtgtttcattcatataatgaggaagtgccagactgtattctaaaatggccgcaccatcttacagtctcacctgttagtgtgcaagggttccagttgctccatgtcctcaccagcacttgttattgtccatctttttgattctatagccgtcctagtgggtgtgaagtcgtatcagggaggatttgatttgcatttccataatctgttgagaatatttttgtatcttatttttatagtgtacttttttaaaaaagaaaaatgtgttacagatatttttttccaaatttaatagaagagtccaagcatggcttgggttttagaaagctgtgagccagaacagagactctctgatcctactggttattggtgttgcctctggcagaactggaagaggctccaataagtgattagatagatgaccaggggataaggaagaaaggtgactgagtgactgactcctagggatgacagacacacagaaagaagaatcatgtcctgagagcagaattccgaattccaaagaacctcccactttgtgctctaattggttatgaatctgcctttctctgcctgtctctcacccacttccttgtgcattatcttcattccttctgcctttcactgcaccctcctcccaggtgtcctgccagtgctcccgacatttacaaacctcatcccttcagcaccccagagccaggggagttaagaggttgctgccacaaagcagccttgttcttcagaatcagaaatagaagctgggaaattatatatcatcatgagcagttatctcctgggaactgtagacaaaagcaccccgtgtgcccctcacaagacccaggctgtgtattgaagtggcaggtggcaccccgtctcctcccctcactaaagacagggtcagcttggacacatcagactcccaaactgtcagagttacagctaacctgaaaacagcctcccaggattcccaagcctcttgtgactcgccctggatgtcgtccagacagctggttagtcatggttcaagggaaatcgcatgggttgtgtaggtgtacgaaggagatccttcatgcacgtctggaaacagatgcagatgatccaccatcccctgaggattgtccagttaacgtttctggaattgggtgccgcagagatggaaatcgcgtttaacacacaagtgttccataataaccaatctcttgtctactttgtggtctgctttaaagagaaatcgccaaaaaccttttaatgtacaaaatgttatatatcatgcaccaaagctgtattacaaatgactagatgtctttttctctctttagtgcttcagttatctgcacagtttactgggccccgctttattaggggcttgggttgatgtttgtgcctttctagaaaagtaacctttcacaatacttgcctttgaccaaaaagggggctcccttctctgtaactgtgacagctccctccatgccatgtcccttgaacaggtctttccaccatatcctgaccttggaaacccaggacaggcagggagaggctagagtcttgtgtgctttccttcaggatacttcaaaaatagctttagctagaaacagttgggtggcaactaagagggtgtgtaaattcagtcctcagggaaccaaaggccgagtctctgccccatgtgtcagagccggctccagtgtctgtgtgtgatggggagttcccagcttgcattacccagtactcctggtcggccatttattaacacagaggaccagcactgtgctagaaattccttgttacatctgtttgtcttgggtaggcagcagcagggcctgggagctgcgctcctggctggaaacagttgcacttggatatcacttctcagggtgggattaaacacagacaaaagctgaggatttatgctgcagcacagggctcggcagccacagaggccactctgtgagcgtcaagagggccaggagcaggagagtctggcctggagacagggccgctccactaccacccagtggctcccaccctcctggactccagccaggagtgcacaatcctcgtcttaaataggattgagcaaaggatgggacaaccggcgtctgttgtataagcctaggggactggggactgggggcctcgactgtcatggccactgcactaatttgtggagttaactaacattatgtattctaactctgggaggaaaggacatttcagccaccgggctcccatgtgttccaggaggctgctgaatgatgtttctctagcggcactgcttggtaccaccccgcctggccctccttctcggggagcagccagcctcttcgtttgaaggcatctgtcctagaggtgcactgcttctccttctgaatggtgtgattggaagtgatccccaagcactctgccactcttccgcttattttggcccaggcaaatccagccaacattcgagctgtgggtcccgtcagaaagaggctggctcactggccagcctgctcagggtctgccgtgtgcttcccaccgcagcagctaccacaggcgctgagaaatcgctccctggtctgtgtctgcagacgcagacccaggaggggccccgcctacttccaggcacaggctgctcgtccgcctggttttcctggagggaactgctgcgtagatttttcacgagcaagtccttacaggtggtttctgttttgagccaggttttcagctaggagcttttttgggagtctgtgcagatgaacaaaatcaacactggtcaaagtctagatatctacgaggaggggataaattatgataaatacatctgatggatactagctagatctttttattaagaaagtacttctgtgctaaatgaaagaaagcaggacacaaactgaatatacgttatgatcccaagtatgttacaaaacagaaagaaaaagatgggaagaaaaaacaccaaaatattaacattggttttcttgagaaaatgggaattccggtgatctcttttgatctctcctgtatttccttatattttctgcagtgaatgtgtattaacttttattattagaaaatgatttttaaaatttaagtcctagttcaaaaaataaacgtgtcagagaaagggggcagatggactcctccgacttacagggcagctccatggaacgccatccaggtccccagtgcttctgctggcagcactccactgataagcatgttgagagtgaggaagtttcttcccgcttctgtgccccctttctcccaatggtttcctcattgtcaggccacgtacatatctgctgaattgagttggaggcacgtgcattctgtatttttctaagagtagggccaggcttttcctgagcagtcgggcagcggcagaggggtgccctgtagggagcttacccaggacctgccaagcacacctccttggccacagtcacagcgcacgttctgaggcaccaggctgaaggcgcagtgcctgtcccagcagtgataagtatttgtggtttgtttttgaatcagactggggaagactttgagccctgctgagactcagagcatctcccttttatttgctttgctgttcgtgctaattatggaagagctctgtttttccaggaggaatggctcctggttggcccgttctcggccaccaaggtaacagggaaagttgggtgttcagtcatgactgtggactggacggaggtggcaccggtgggagaccaacagaggaagccctcctcccggctcccaattctggctttcgctagaagacaagagaaatgaggaaaacagctaccctaggaaatagccttccttgaaaatggtttcctttttctcaggtttgatgaatttggggatttgttgttgtcattttttaagtaaaaaaaaaatgccccaaacattagcgttcattatcctagtctgatttgggtccggctctacctgtaggagatgaatgtggtaggccagggggcccctgtggattctaatttatgttttcagttgtttgccattttgtatcttcattacggggctactttcctgcctccctaaagtcatctttcccagcatgctgtttctggactttatttagtaccgtggttacctcctgcaggctgtgtggccccatccttcaccaaaatgtcacctcaattaattcggcggccatgagacagatccatcagtggcccgccgactcccgtcagcaggcgcccatgagtgatgggcacctccacgcctcccgcggcccccccccgccatgtggagtcagccgggcaggactcaccatccctctgggcacgagggcatctggctggcccgagtcctctcacaccttatgctgagggagacttcagcctcaggaggagaccccaggtgcattcactccacctagctggccttgttccccagccctgcactcagggatgcctcaggagagccaacgctctggcagggcagccaggtgccctttccctttgggccaggcccaggcagtggggacttaattgaatctgctcattcccaccccagctccacacagcacagcactgcaaatggagctggcagaagagctgacttctcatttctctttcctctcccttctctggtccataggtgtttgaggaactgtggaagagggaaggcaagactccagggcagattgtttcagaaaagcagcttgaactgatgcaggaccagggggcactggagcagctctgccactctgtgatggaggcc

SEQ ID NO: 510 - DNA, 111089 bp, Homo sapiens
catcccatcgacctggtcccccagtccagtttggcactagtgacaaggtctgtgtgggctggatctgggtatcctgagttgggtggagagaagggaaggactaaaggtgggacatagaggacacatgtctgtcacgggacaatgtctcctgccttcttgtgatcacaggactcagacttacgcctagtggtaggagacagcttgaaagcagagaaggagctaacagcatcagtcactgaggtaagtgggagtaagagtttggtggaaaggcccaagatttctggggaagattgctgggagtgaccagggcgtccaggatgccagacatccctctccacgaggcctctccttcccaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcaggtaggccccgcttcccattgcatgaccccttcagtgaataataatttttttctgcctggtatgtatttataatcaagcctttctacgttgcagagttgtgagataccactttgtcacatcatttttctccctactttttgcttctatgggtgggatggtgatcttttttcttgaccacagatactaaagctgtttcaaccgtgctcctctcctgcagatctctgggggagccatggactctcaattacatccaaacagtggaggcttccgccctgggacaccctcactgcacccttacaggtaagactcgatgcctgtggatcacagaagtacttggagatgtgtttcggggagagggaaggggaagacacagttctagggtactagaagctagtggacttaaggcattgctaggactctggcttcctaacagcttttctccccacaatttattttcagatcacagcccctatacctaccccccggcccagcccctccctcagcactgctctctgggttagctctcaagggccagtttctggatttctccacaatgcaagctacagagctggggaagttgccggctggaggagttctctaccctccaccttccttcctctactctccggctttctgccccagtcctttgcctgacacatcgttgcttcaggtaagaggggggcaggtattagatattgggggatagggtagggagaatgattttgtgggggttgatatatttctccctgtttcccgacaggtacgccaggatctgccatccccttcggatttttattctactcctctgcagcctggtggccaaagtggctttctcccttcaggggctcctgcccagcaggtatattgtatcttcacacttccccttcatttgatttctctgtccagttgctggctttgattttccctggttttctgacattcctccctgcccccaacatgcacacccaaatttcttgttacagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagaggtaaggtacaggaactgaggggctagggagcgccaagacttgggagtagggattctgtatttcaaggtaggcagctcatgatttttttcccctcagctgcatccagtggaactaaagccgttccaggattatcaaaaactgagcagcaaccttgggggacctggatcatcacggactcccccaactggaaggtgaaacggaatagggatgtggactttccaagtgcttccttactttggaaccagggtctggatcctaggcttgccttagacgcccttcttcccttaggtccttctctggcctcaattcccgtctcaaggccacgccttccacctacagtggagtcttccgcacccagcgcgtcgacctttaccagcaggtgaaggagaaacccttgtggccccaactctaaattcgagttgccacctgatttcctgtccttccgtctcatcgctgacctctcactgtgactcactgtttaacacatgcctgtcccctaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttctggggctggggcctcacttcccctcctcccccttcccctggtcccctgtccctggggctgtttgttaaaaaagagtaataaaaggatttaaaaaaaaaaacttctacaatgatttgggggatgagttgtttgcattgtcttaaagcatggtgctgagtgatctgtagtttcagtcagggaaatattcattacttattccagtgagctgttgaaactaaaaacatgaccatcgtattggatctttaaatttttgtgagtctggaatttgggctgagctcagctggataaatctgcttttttgtgccagtgagcgaggtcaactggttatcagtctgcagctgacacctgggctggtcccaatatggcttcctttgcatatctagggccttggtgggacatctgtaacattactgggttatcaaccagtgtcttcacatggactctccagcaggcctgttaaatgtccgtgagctcatgttccaagaggtctagctggaattttctaagcttatgccatgcttagttgataagagcactaaactagccaaggtaggggatgggggggtttagaagggacttcaactgcatctcaaagggactagcaaagaatttgcagccatgggacttcagttctttatgatgaactaaggggaaatctctgttaaggcctcaatgttggagcacacttaaggggctctttgaattggatagaccaattccagcattgtcaaactaagtgggatttcacatggtaacgctgcatgctagttatgctaaagactatacttaggtctgcagctgctcagaaactttttttgatgggtaatttgagagctctatgctagtgtgcacctggaatatgctcccaactcaaaatacaggttttttatttatatataaagtgctttcgcacaaaaaatacaaacatcaggctgggcgcggtggcccacgcctgtaattccagcactttgggaggccaaggcgggtggatcacaaggtcaggagttcgagaccagcctggccaatatggtgaaaccctgtctctactaaaaatacaaaaattagccgggcgtcgtggcggacgcctgtagtcccagctactcaggaggctgaggcatgagtgagaatcacttgaacccgggaggtggaggttgtagtgagccgagctcgagatcgggccactgcactccagcctgggagacagcaatactctgtctcaaaaaaaaaaaaaaacaaacatcaaaactggcttgtacaatttagcgtgctgagtagaacacaacagtgttccaaggaagtattaatttaaaaaagttcacacaagattaagggacacactacctaatggagacaatgtagagagaaagcagccagaaaaatccgacttttatttcttaaatactgtgaaggaagaggggggaaacggtcccctgatgaggaagggccatagagcaaagagctaaggatcatcagcaaaggcccgctgggcattggggaagcgctggggactgtagttggggtcttcctgcagtcgtttttgtatatcagaccggagctaaagagaaaaagtaagcaggttggagaaacgctggccaagtccccatgatcccagcaagcacacaaggccatccctcagaagctaacatttccccccccaagcacactgtcaaatagcccggggtggcactgtcaagccttcccagatgccaaaggggaaaacaaatggtagcaccaggctgaccagttcatcgctgaagggatccagggaagagggaccctagcccaacccctcccactagaccatccctattctgcttcaaggtggcacctgctgcctgtagctctcctgaacctctggtgcctccaggtcccggctcaggctctcggggctcgtcaggggccgagctccggctgccttagctgcccggctcacagcctctgagagaagcagctgggggccctcaccctgcatcgtctgggggacagggggttgggagggaaaagaggatcaacgtcagatccagtgccaccatccggctcaccctttccatgagtcaaccactccactgagtctccatgctagtggagagaggggaaattaagagtccaggatgtggtttttacagcagaaatgccttcctaattctctttggcactagccaaaactaaagtgaatgtgcttgaacgtgctcttcaaaacgaaaggcagaaggggtcaagccatccgggattcagagctaggtaatccacaagaggaaacccaccttaaaggaaaatgggatctaagcacatggggattaggcagctgagcaactaatacaggactgctagcaaacagactaaggtcaagtcctgtatggttatgcaacaaccaagagcaagtctgaatcccagaaaaagtttcctcattaaacgaggggaggggagactgaataacaagagctcccaccatctctacatagtttgattccaggcatgacggggaaacctggatagagagagaggcttagggaagaggaaaaccaaccttgcgtctcttggcaggcataccactgaggtaggcatcactcagagggggctgcggtttcaccttccgctggctctgaatgtcctgctggataatagggacccattcctggggaggaaaagagaaaatagtaatgtccttgactttcagctgccatgacccactggattacttcctgacacttactggggggactgcagctgcccaaggttctgtctcagctgaagctccatcctgttcatcccgggagcccccctcaggagcaggaggtggacctcgggacatggcctcttctgctgttgttccaggggctggggaagcattctcccgctgggtgtcagatggcgggaagagccaggcttcagaatttttagcctccaaacctttctcccccagccctccactccacattatctggcccctcaacctccccctctctagagtacctgaggctcaggggaagctctttctgctccctgaacttccattggctcctcaggaagtggctgtgaaattaaagaacaccatacttcctctcagatctctccagttctctcaagtaccctgaccccatcgcccaacaggtcccttacctgggggggatcaccaaccctgcgaacgtatctgagaatggcatcagggcctacaggcatgtgctccagtaccacctgaagcctcagtcccatcatagtggtcagccagctcaccaaggagggattcaccccacgagacatacgacgctgagggacagaaagcagatttagaacacaaaaccctcaaccacctttagaaatagattagatccaggttacagaatgtcagtttagaaaagaaaaatgaaaactgcagagaatggaaacctcaggaaacaaaaggctaaggatctggggctaggtggtgcttacaattcggccattgataacagcagcaagctccatctgctgtccccccaagcagtgcaggtttagggccaggcattcaaacaggccttggttacacaactccagcaaccgggccccaaatccactatctgtgggcaaaatacaaggagggaatgctggcacgtggcagccctgcacatgcaacaggccccacttgcccccgcctggccagcccctgacctgtgcaatgcagcacatgcgcagcaatgctattaaactgctcttggagaaattccaggtttgtccggatgatgtccacacctggctgaacctgcaccaaggactgagagacaagataacacaaagatcccaaaatcaagaatcataagactgggagtggaggaggcagctgccttgaccagacccaggagaggaaaggaatagagaagggttactcacaaaactctcccgcacatactcttctagccccgtgatcaatgtgtgggttgccatctgtggaggaaacagaacaggtttagttcaaagcctcagtcctcccaagacttccacctcgaccccaacaagtccagggcttgtgtgggggcaattggagctttacctggcagagaagcagtcagaaataaggaataaaatgtgcaaaagaggagagttctggggcccctggccttcatttacccggatgttactgggtgtgggctcctgaccacccaggtagtgctggtggaagaaggatcgcagctggggctggagccgttgtagtggctggaaatgcccatggagaagcatcactacgtccaccatagagaagttctggcacagaagagaaagcaaggccccaaagaatcctgggggacaagggcagatgttagcaatggcctttaccacctggcctgcccacccacaaccagatcatcaacctcatcccaccttggcaacacccctaaaccaaggccatctacattcctctggctgccccttcctggagcaagccaaagcatcctttttgctcaccaagggccccatcagctccaggctcaaagatgttgctggatccactgaggcgttgtatgaaggcagcaatactttcactgctgccagcccgagcccccagggagcccagcagggagctgagcacaccctgcaccactgaggtaaaaaactccggtgacaggctctcaagacccaggcctccaggactccctgcgccaccagaaggggagcctggtgggggcatggtctgctgctctggggcaggtggtgggggtggaggaggtgggggtggtggaggggctgtctgtgttgcctggcaaataaagaaagaacaaagaacagaaagtgaggtgagaatgaagacacacggaaataatacggcatcaagagggcacaaaccaacgggtctgggaagatggggagttacattctgatcttcactgcttaaagcagaagtatggtaggtatttaacagagtcaggcagcacaacttacctacctcttcctctgaacaggctgtcagaaagcagtgacactaattactatactttctttttctaaacctcattttcttcatctttaaaatgaaaggttcagagtcaatgaattcccagggccccttcccctaacatgtcactaggggctcttacccagtggttatataatggcaagaaggtaccactgcctggctgggccgggggacaggaagatgaggtgaatggcaagccagccactcacctgcaagaagtcagtcatgccttggagaaaggcagggacaccaggcatcgccacagtgatggtgggagaagccacaccagaccctccagcccctggccctgcaggccctagcaggttccccagaagctgagagaactgaagatcagccatggagggttgaggggtgggtggaggctgggcaggccccccaggagcggggccagctgtggtagctgtgttggtggtgccagcactggcagaagcagtggcaggggctggcggtggagccatacctggggtcccctgagctgtaagaaaccaaaaaaagaaagctgggctgagcatggtggctcttggctgtaatcctagcaactttgggaggccaaggcatgagaactgcttgagcccaggagtctaggccacatagcaagaccccatctctaccagaaaaaaaaaaagacaattactagccaggagctagtactgctagctactcaggaggctgaggtgggagaactgtttgagcccaggagttcaaggttacagtgagctttaactcactggattgcaccattgcactccagtctgggtgacagagcaagactctgtaacttaaaaaaaaaagaaaaaagctggccgggcacgatggctcaagcctgtaatcccagcactttgggaggccaaggtgggtggatcacaaggtcaagagttcgagaccatcctggccaacatggtgaaacccccttctctactaaaaacataaaaaattagctgggcgtggtggcgtgcacctgtagtcccagctactcaggaggctgaggcaggagaatcacttgaacccgggaggcagaggttgcagtgagccaagattgtacactgcactccagcctagcaacagagtgagactccatctcaaaaaaaaaaaaaaaaaaaaaaaaagctgaaacctgaagacacaagacactacagcagccccattccaggaaagcaggaaccaagaaaatatggaaagaactggaaagtgccagtgagcagactaggaaaggagtttaaactctgagtggggaagaatgaaaactcacccacaaggactggctgcataagaagctgccccacaaggccgctcaccatctgggccaacgaggcattggtacccagaccggcgccctgctggatagagagcaagggagaatttcagacctgcccttccatgcaccaccacaggagtctctccctagactgttacgcactagaactccccgacccttgctcaccagtgtcccagagactgggggccctccaggatgggaaggccgagcctgtggaggagtgggccgggcaatcaccacccgggttggagctgttgggaagcctggcacctgctgtcctgtgggtggcagaagagacagaccgaagagggctgagggccaggcccttgccagccagctgccaccatggactgtgccctacctcccaagcctccccttccaggtcattacctgcggccgcggaggcaacagctgccaccatggcctgatgagtgatctggtgggcgacggcgtgcatgaactcagggggcagggagggcagctggatgagggtggagcctggggggcgggtctgatgtaaccttgaacctggaccccttcaacccacccactcagcccttccctttctctacccagagctcagcctgccctgatgccctcactcttacccagggtttggccatgaccagggggtcccagggggccagtgggagcactcggaacaccaccaggctgtgtgccagaatctgggcagggagacagagacagtggccctgaggtaggtagggccaaggcctaactatatccttctgagatcaggcatacttcaggcccataatcccccaatcagaaagcctgcctttccctccatctaaacagggagaggtactcccttcaccacacaaacacacctccaaagacaaaccaacccccacaccccccacatctgtctacttaagcttctgctctggtccccaggctaccaccaccagcatgtgcctctcccttccccaccctgttccctcacacctcagcatgaacctccctcatcatgctgatcctgctcttctcgccagcaactattctcaccttgaatgttcatgtgcatcatgaccacgggttccacactctggtgggaaatccggatgaccctcgggtggctggtggctggcgggggagctggacctggcgggggagccccctcagctgaggactcgacattggtagaagacggagccacggatgaggcctgcccaggaccagggggaggtgcctctgcattgggagttggggggggccgagtcccatttcctgtcatggtcacagtggttcccacattgatctgaaaaagacagatggacaggcagatgtgagaaaaatacaagagcctaaccaagaaaacctcatgataaacctctaaagtatctccagccttcatcaccatgtttccagtctcctcctttcctaacctccttcaggcccagtagctaccctgggtcactctatcaacacccctcactctccctcaggccagactccccctaacccacctgtatgggaatggctgcctgctggagcaccatgggggtggtgtagtgagacataggccggaccacatgcaggtgtcgtgggggcgtgcaggccagattgcagcgcaggtcagacagtgcaacaaaggtgttgcccagcagtcgcaggctctcccctaccaagttgatcaaccgctgatcctcctcccggccctcgtgctgcgcacaaccagccaaacacaaaaaggcagaaaatatcaagctggagtccatctcactaataaaagcaataatgcctactgagaataccatgtcctccaaaactttcagttatatccttggaagtttacatgtagaccaaatctttgcaaataaattatatcttattcacataaggaacatcctattaaaacactactatgaatcagtaagtcatcatatactgatctcctgtactttacattttctaaattcattcaggggcacaaggggtacgatacgaggacagtgcttacagcaaagattatcaccttctctgtaagggaggacaaaatcacttacaggtttagagagaaattgttttgttgcaatgtgtgtttttttgttttgttttgttttttgagacagtctcgctctgtcacccaggctagagtgcagtagtgcaatctcggctcactgcaaccccctcctcccgagttctagcgattctcctgcctcagcctcctgagtagctgggattacaggtgtgcaccactacatccagctaatgtttatattttcagtagagatggggttgcaccatgttggccaggctggtctcaaactcccaatctcagatgatccgcccaccttggcctcccaaagtgctgggattacaggcgtgagccactgcacctggccctgttgcaatgtttttccagggagggaaagagttatctgcatttcagcctgttctgttttgggagtactggggctgaggagaaagggcagggccatcaaagggctcacattgttattgtagtccgtggtggcagcagcacccagaacctcgtagtagcgctgcaagaagggctggaggcgactctccagccgctgtagctcctggagcacctcgacatactccgcaggggaaggatggctgtggacaaacccaaggggcaatgagccaaagccttcctcagattcccaccctcacagtcaacagggaccacatgtgccctctttctccctggtctcccagagccctggcccaatccttctctggaccagcagagcttctattctcttcaacctccgcctcccaggttcaaacgattctcctgcctctgcctcccaagtagctgggattaagttgcctgccaccacacccggctaatttttgtttttttttttttttttttttttttgagacagagtctcgctctatcacccaggctggagtgcagtggtgcgacctcagctcactgcaagctccgtctcctgggttcacaccattctcctgactcagcctcccgagtagctgggactacaggtgcccgccaccatgcccagctaattttttgtatttttagtagagacggggtttcatcatgttagccaggatagtctcgatctcttgacctcatgatccacccgcctcggcctcccaaagtgctgggattacaggcgtgagccactgtgcccggcctgtattttttagtagagacagggtttcaccatgttggccaggctggtctcgaactcctgacctcaggtgatctgcccgcctctgcctcccaaagtgctgagattacaggcatgagccactgcacccagccaaagcttctattctttactcccacccatgagaggatagggagaagaaaatgaactgctcccaccctccccaccacaatcctgcacctacaatggtgaaagactaattctaagaaagagagcaggccttcgtgaactcagaggagaattccgatcaggctcaggagataccatttggatttccttgccgtagggagagcagcagttcttctcagctgcctgtcctagcgtcatttacctataccgagagagcccctcctcgcccctcaatgctaacccttcaactaagacctccaagtaatcctttccctcccttgccatggttcatttccttctccccatacttcacttaggattccccacccactaaagattccctccatctctcacttgggtgcatttgtttccggggcaggtgttgggcccgctggggctgggccaggagtgagctccgggttctgggctggggcacgctcctccacttcttctgcctccatgggctcccggggaggtgcttcactttcaactggttctgatgtttgagagctcaaggctactggctccggggtcacagccggtggctgcgggggcggctgactgtgctgcggttggggccctcctcgacactgaaggtaggggagagtcaggataccaaaggcagggtaagactgctgcagaggattactctacaggagactgaacagagaaagtatcctaactagactccctgaaggcatggctctgcaattttatctccgactcgctagcaactagcataagactgacacaaattagatgcataataagcatctgtaatttttttttttttttttgagacagagtctcgctctgttgcccaggctggagtgcagtggcatgatctcagctcactgtaacctccgcctcccaggttcaagaaattctcttgcctcagccttctaagtagccaggcctacaggcgcgtgccaccacacccaactaatttttgtacttgtagtagagacagggtttcaccatgttggccaggctggattggaactcctgaccacacgttatccccctgccatggcgacccaaagtgctgggattacaggcaggagccaccacacccggccacagcatctgtaatatttgtaaataaatttctaacaaagagtagagattgtggtttcctttcctccacaagttggtttcccagcctccacaagttaagagagtagaatcctttaattgaaaagagatgccatgagactaagtctgaaacaaactccccagataccaggcaccaagaggattggcagaaatgagagagcctcacaaagatactttttctgcccaaaagaatgaatactgcagagaagactagattatgaaggccaaaccctgtggatgtggccagtgaagccctaactcccaggctgagagaaaagggagagggagggtggagagagaccctagccagccttgcccacttacctccatccgggatagtaaggtctgtatatccctgatcatgtgctgagccatcaccagccgtacccggggctcactctacaatgagagaaggtttatcagggtaggttacagatgaagccatgagttctaccacctactaaatcaggtcccagccatctctcagccaggtccaccccacctcccagcctccttctcccagatccccttccctgaccctcggaggcccctcaatacctgaatcggggcctgttccatgttgatgtgaacatccacagcagagccgtcactctggggaaagggtaagggaagttgttctgggagaagccaacactaaggcctccacacctccaattcattccctggagccctacctccttttctccttaaagactgagaccaatagcacaccacagggccccctgaacccaatctaaagatggaagcatctatcttattaattccctggtgctaccacaaccaaagctacccacaaaagccctcccctgtggaacataagcttacaggaagattgaaggttccaaccatgacatagctgttggcattccggtcatgaacagaggccccaggcccccgagtaccagggggggatcccccaccatgagtggctgaggcagaccccgtcccagaagatgccccagaagggaggtgagtctgaggaggagcccgttccaccaggtggataacctttcccccaacatctgcagaaaaatagacacacaccaaaacatagtatgaacaggtaaacccatggcctcagttcatccctccagacagtagccccaacctctgaactgcctccccagcccccttactgtattcctgaagcttcttatcatcttgcagaactcgtccctggtaaatgagccgttgtttttcagatgggatgctgacagaggcagcaatgtgctccttaaactcttttacattcatctgaaaagaagaggcatgcacaggaatggaaagaatggaggaaagaggaagaacaaagacagacaaccgagttgtggaggtgaggggtaaaaaccaccacagaatcactacccgtttgtcttgaccgtgagatcattactgtgcaaacccttaaactaaagtaacagctgtcaaaatacagacaataaatttggcttggcgcggtggctcacacctgtaatcccagcactttgggaggccaaggcaggcagatcacattaggtcaggagttcgagaccagcctggccaacatggtaaaaccccttttttaccaaaaatacaaaaaaataagccaggcatggtggtcgcctgtaatcccagctactagggaggctgaagcaagagaatcacttgaattcgggaggcggaggttgcagtgagccgagatcgcatcactacactctagcctgggtgacagagagggactccatctcaaaaaattaaataaataaacttaatgaagctcaggttatagatccaggaaaaataacacggatgaaaaacaaaaaaaaaacacatggacattatattatctgtctggcatccaagggagtatgtgtctagagacatcagtgacccctttccaaacacaagatgataccagtttatttaccagactctcctgtgatttccaagattaaaaaatggcaaagaagatggggtctggtatcaggttaatgaagaaagactaagaagataagaaagcaaaaaaggtcccagcacagtggctcacacctgtaatcccagcactttgggaggccgaggcaggtggatcacctgaggtcaggagttcaagaccagcctggccaacacggtaaaaccctgtctctactaaaaatacaaaaattagccgggcgtggtagtaggcgtcgtctgtaatcccagatactcaggaggctgaggcaggaaaattgcttgaacccaggaggcagaggttgcagtgagctgagattgcgccccagccctccatcctgggcaacaagagcaaaactccatctcaaaaaaaaaaaaaaaagcaaaaagagaaatatttttcctaactacaaactgactcttgggaagtaccagagtatttatatacatctaatcacaagtctatatatggctttcttatatccaggtaatatcacattttagaaaaccatggaccaccccacatgcaatttgtctccaagtattacaggagtaaagacacagatagctatgtccaaggctttaagctcaagagactcaagctatgccataaaaattagtaatttcactcaacagtctatcaaggacctatctccattatgggttctgatttctaccctttaagaacacagcatagacctgaccaatgtctatcagtaagacacacttgcttagggttcctgtgctgtttcccttcccaaaggccagagccatgcctgtccctttgggttggggtccacccatgatgatgacacacagattcttccttcctctgtatttccctctgcattaagttctatccatgtggaggacagaacaaaatcagcctcactcacaaaacatcagaaaacgttctactggaatacgaacaaagggatcaataaaaataaaatctgaggccaggtgcggtggctcatgcctgtaataccagcactttgggaggccgaggagggcacatcacctgaggtaaggagttcgagaccagcctgaccaacatggtgaaaccccgtctctactaaaaatacaaaaatcagctgggtatagtggcacacgcctataatcccagctactcaggaggctgagataggaaaatcgcttgaacccaagaggtggaagtttcagtgagtcgagatcgcgccactgcactccagcctggaagacagggcgtgactccatctcaaaaaaaagaaaaaaaaagaaaatctggtgaccagaaaatcaagctcatctctcaggctaaggggcctaaacgaggaaaagctaaaggtgtcttccagaactagtgaggtgtctcacctgggcccccacaataaaggtacgagtttgagagtccaaggtcttcaccaacacctccaagctgtcaggctcctccacagcggtactggtactatcattaggctccatggccgacaggtctctaaagaagaacgaaggaaggaaggcccgctgttgcccagaccagagtgtacccgaaagactccctagcattaatccctgccccaatacctaaaaagtttctcctgcacacacacacattcacacctgtccccatcccccttctgattccggggcacagggagagaaacacaaagggcaggagatcgacggcttagggagctggaggacgagaggtgggaggggctccacgacgccaatcacaataagcagggagccagtcagattaggaaggaagcacgagaccagagactagtgtcatcaccggtcacggcaggacaagcgccccagaggtcggaaaatcctgggacaacgcgaaagcggtggtcgccccacactctgcggagaaagtggtttcgcgcacgcgcgccacgcccatcgaaccctcctaactcactatagacccgaaacggcactcacggggcgacagacctgctagctgactgcccgcgtctactgccttcccacggtgttccagcagaacggcacaactaacccacagccaaacacacacacacacacacacacacacacacacacacacacccaccaccccgcggctccgcccccgacttccccacggaccgtcacttccggtctcccccaaacctgccaccgacggccacttccgtttccccgatagtatttggggatctcgaagcgatacttccggctccccccaggtccccaagctttacttttgtggggcacgacgagaaagtccgcagccccaaacagtgagtttctgagggcgagtcgggccggggccggcctaggtgggagggagccgagcaccccgaggagccgccaccgctgtcgcccgggggaccgtactacgcctgcgtgcgtcgcactacggatgcgtggacacttaagcatcgccccaccccctcccccctctggcggcgttcacgtctgtgcgcgcgcttgagcgctagaagattgaggtggctaccgtaaatgcctgaaaaacagtcaccagctgggactctaccactgcctcgagaggggctatggacggtcgtatggaccttggactttggagatgggggattatgccacattcatctatgtttaaatcttggcaggctgataatttcaggcggcactgtcctagccagctaaaactcttctccaccctattgccctcgctgcgccctttcttctgtgcctccggaagttactctttcagtaggcgtttgggggcggcactggtcaattttgttctcggttgcttggttgggctagatttcggttctgccgggtgggcgttttaagggctgtgggcgtcacattcgtcggtgtgtggccaaggggacatgacacgttttaggaaaagtaaacgtgctactaagttgcacgacttgtcaagaaaagaggcgcttccgagtttgagaattgggagcaaatggagtccgagtggacagaaagacaagaccctgaccgtggggaatttaaaggccggccagcgtgcttccgaaggccgggggtggaggcattaccgcctctccgtgccctcttctcttaacctgccctgggccaagggcctcggccccgcgaaactgcgagtcctccagaaagacacatcgctgttggggtgtccaacctttctgggattcgtagtttatacccaggtcctggttatattttagttaagagttctaataagcagctgtttaatgagcacttgtgccagcccatatactacgggttttgtgtattattttaaaaagccttttaacgagcttttaacattttttaagtgagtacacttagacgaacataagtgtcagaattgacaaatccaggcctacaggactccagatcgagcacttgtactttactgccccaataaaaagctgttaacattttagcttatttttttgagagagggtctcgctttgtcgcccaggctggagtgcagtggcgcaatcacaactcactgtagcctctgcctcccgagcccaaccgatcttcccacctcagcctccctagtagggaccacagatgcacaccaccacacctggctaattttatttttatagagatggggtcttgctatgttgcccagcctggtcttgcagacttggcctcccaaagtgctgggattataggtgtgagctactgtgcctaaccacattttagctttttattacaaaaattttcggccgggcgcagtgactcacacttgggaggatgaggcgggtggatcacgaggtcaggagttcaagaccagcctggccaaaatggtgaaaccccatctctactaaaaatacaaaaattagcctggcgtggtggcgggcgcctgtaatcccagctacttgggaggctgaggcagagaattgctttgaacccgggaggtggagattgcagtgagccaagatcgcgccactgcactccagcttgggcaacagaacgagactcccatctcaaaaaaaaaaaaaaaaaaattcaaacattacaccaaaatagaacagtattaataaactctaatatactggtcacccaaattttgtttgttttttaactaaatcgcaagcctcagccctcggcaaattttttgtggcagtccatgggatataaatttatcaagctaggtgtggtggctcatgcctgtaatcccaacactttaggaggctaaggtgggccgactgcttgagctcaggagtttaataccagcctggggcaacatggtgaaactccgtgtctacaaaaaattagctaggcgtgatggcgtgcacctatacctcctactcgggaatcatctgagccggggaagtcaaagtcatgcctgggcgacagagtgagaccctgtcttaaaaataaataagtaaataaataatctatcgaggaagatccatctctcacagcattaactgctccagtcacttggtgctatccaaggacaacctatttggcaattcttactgcctattatttgagaacttattacccaccagaaactaagtgctttgcaaacattactattaattatagcaaatatatactttggacttaccatgtgcaagtctttgctaagggctttatgtgcattatttcatttaatcctataagattgatgatttgccaattttacagatgaaaaaacagacatagcagttaggggttggtggtgttttgtttgtttggagacagagtctctgtcgcccaagctggagtgcagtggcacaatcagggctcattgcagcctcgacatcccaggctcaagcaatcctccctcctcagcctccctagtagctgggactacaggcgtgtgccaccacatcggctaatttttgtattttttgtagagacagagttttgccatgtagcccaggctggttttgaactcctgggctcaagccatccgcccaccttggcctctcaaagtgctgagattacaggcatgagctacctgccctgcctgtagttagggtttggacacattctgcctgacaccaacatctatcctctctaacagccagattacatagcctctttgtagtaataaatgttgagtgaatgtgtcagtgaacactgccagggtatacatatttttctaattgtaaactaaagagagcaatccaccgtgccccagcacctgcatcatacctgttctaaagcatttaccaagttgtattgcaatggtttgtctacacagctagttttccctctaacgacttcttcaagatcaggggctatgtcttattcgtttttttatgtccccggggattagctagttcttgggaaacaactgggacttgggattcaaaacagtttgctaagtgaatgaatgagaggcccagtcaagctacttcccttcagtgctgcacagtgcaacaaataaccagctcagatacaggttcaaagaccacaggcttctccctggacagctcagctctcctcataactcctgagaaaccctggacatgccagggtgtactatggagtggttgcatccggaagagggggaggaagtcccaaacactaagtaatccaggtttgggttggaaaacaaggttgaagttactcattagcaggtgaaagggtcaagggtcgaacgcaagggagctgaaagcagagtggactgagcagccagtaggggagagagcagttaaggcacacagagcaccagctccctcctgcctgaagatgttccaccaaatttgggcagctctgctctacttctatggtattatccttaactccatctaccagtgccctgagcacagtcaactgacaactctgggcgtggatgggaaggaggtatggactgagattgggggaagcctatggtggaggctctgagggacttgggtggatggcctaggatgactggagaccatcttgggaaaggaagagaggaagggggtgtgagtgttgtgataatgaaagcaagaagaaaaatatcagtactgtggccatcaatgcagaggcatggcagaattggggggtggggtggttacccaggttgactggggaggggcaaagaggaaaagtcatttaatgactctttgtcatggatccaatccccagttggaaagaggaaggcagccaacacctctacccctaaatcttgctgttttgactgatgaagaggttgaacccatcctgtgctggaacccaccctcttttgctcccttcattgtctctccagttcccagaggtccacttgggccagtggtactttatcgcaggggcagctcccaccaaggaggagttggcaacttttgaccctgtggacaacattgtcttcaatatggctgctggctctgccccgatgcagctccaccttcgtgctaccatccgcatgtgagtggtaaggaggcagaagcatcactgggttcagtctctgcccaaagtgtgagaatccacccaccaagagctggcctcttagctggtatatctactatgcttggcccacggaattcagtggctgtattaattgccctctggagaaagatgtgcctaaccaatgcttggtagcttgaaacccaaggagagctgggcttcaataacaaatacaatggagtaaatagaagccgggacaggccagacgtggtggctcacgcctgtaatcccagcactttgggaggctgaggcggacagatcacgaggtcaggagatcgagaccatcctggctaacacagtgaaaccccgtctctactaaaaatataaaaaactagctgggcatggtggtgggcacctgtagtcccagctactcacgaggttgaggcaggagaatggcgtgaacccgggaggcagagcttgcagtgagccgagatggcgccactgcactccagcctgggcaacagagtgagactctgtctcaaaaaaaaaaaaaagaagctgggacactatggttggggtgatgctcattctttcctccttgccaccaccacctctgcaggaaagatgggctctgtgtgccccggaaatggatctaccacctgactgaagggagcacagatctcagaactgaaggttggttcttcccagccctcaccctcccttgagtttggttctgcatctctgttctcatacttctcccacctgccttgacaggccgccctgacatgaagactgagctcttttccagctcatgcccaggtggaatcatgctgaatgagacaggccagggttaccagcgctttctcctctacagtgagtagggatacaaggcaggaagggttggagggaaacaagggagggcaggagaactcctcactctgggtcctatgacaccctcccaggaagagctaggtgcttccaggggttttgactggcctgaccccaccttgcccttccagatcgctcaccacatcctcccgaaaagtgtgtggaggaattcaagtccctgacttcctgcctggactccaaagccttcttattgactcctaggaatcaaggtaaggggttaaaatctcataaaacaggattaggactcaccaagtcttctggtgttacagggtgaaagaggctcgtgtgatgtcaccagagggatgtggctaagagctgtgatgtcacctgagggaggcaggatgggttctgggctactcaaaagagaggtttctgagtttgcactggataaagggggcagagggtcatacgtggagggaaaagagccttagagactcccctttgacacagggaatgaaagaacacgttctcccccaccccattactatcaactttgcttttctccctggacttcccttctgtccttctttttccctccccccatcacagaggcctgtgagctgtccaataactgacctgtaacttcatctaagtccccagatgggtacaatgggagctgagttgttggagggagaagctggagacttccagctccagctcccactcaagataataaagataatttttcaatcctcatctcattctggggtttgtctccagacgtcattcccactcctcccatttcaacattccccctggatcctctaccacctaaactcccagctggacggtgtcagtaagaacagagtggcagtaactctcactttgtagtggtatatttaggatttgatgtgacacagttatttattgctgagtgagcaaacccctagcccccaagtggggactacaggcttcagtgcttcccccacactgcctgagctaccagcccttctgcactggccctcctgccaatactgcctgcactgtccccactccctctggctcccatgatcaccagatccgccctgcaggctccctgtcacctgtggggccctatccagaccccctaatccacttgcctagcagccccactcttccctcgatggctcagatcctgagatccaaggaacaccctgggtttcccaaccactctcttactgcagaggtctgtctatcctgccctggtctcctccaccccaggagagttttcaaaggtagagaggaccctttggtctttattcaccaccatcatacttttttttttttttgcttttaaaaagtggaggtggaaaaaaaaaaaaaactgaaggtgggagaaaagtaaaagcaaaaataacagctggtgaatccaagagcagtgccctcactgtccataaacacaaacaccctaaatagttctgttctctcctgtgtatgaaggggggccctgcaccctcgtactcgggtttcttccccatccctgaggtccctatgcttacaatttgggtcatgcctcacacttttctcctaaagcccacactctcttcaccctttgcccccaccccacggtcacagcccctttcccgggtctcccctctgctcctcaccttccctctccaacccctcactctcccagtcagtggccgcctcatccccattgggctcccggaggctgacagccagcaccaaggcctgcaggagaccaaagaggcaggcgaagtgcaaagggtgggcagtaagtaggctcagaacagcatggagcccatgcagggcagccaggaaggacagtaggccatgtagccagaggcccagcggtccacgcaggcccagtgtgtccaaggctgcccgcagtggtcgtgagcacagggccagcagggcagaggccagcagctccagaagatgcagggtcaggttggtggagatctgcagacactcttctgggccccccaagtaccgggagggagctcctggttccccccgcagccagcccaacagcttctcacgcctaccaggtttctccaatggggctcctggcccagggacgctcagtcccccttcaggggacacccctggtctcctggtgccacctgaatccacatgatcccatctgagtttgggactggcccctccagcctccagtctcccagactcttgagtgctagagataggctggtcccacttgagggaatccattcttttgctccctagctgctcaacttggggctcctccttgcttggttcggaagcagccccagaaaccctcaatgcccccgagtccttagtcttgggatgccccacatcttccatggtttctggggcactatcccagtcacttcctgaattctccgaggagctgtccacccgtctgggttctgggtaaggcgggtcaggcctcattggtttccggcggccccaagggcgaggtagccagccaccaagccgtcgcaggaacatggctggggtgtgtaatgggcccccaaattctgaggctgcttcctggcactactcagactctcaggatctcctcagaagccagagtctttctggctcagaacaggtatttgcctggtgatgcagtcctactctgaattcagaagtggctcctcccttctctgaatagtcatgcagcctcaagtgtggcaagtagtttgcttcctcttcagttctggggtaaaggggggcatacccaaattcattcaccatccacacccccacaatctgagattccaagaatctcagatctgacaaggcctgggtcaccaccagagagtcctctctgcgtttccggatttccttcccagcaggcagcaccccaagtttcactcaccaaggccacaccccaaggtgtcccagaaactggggaggcagtgctccatccaataaagcgggcaggaaggtggccccaggtcctaggtgctcctggatcgtgtagtctttaactgctgccccaagggacctcaaggaataggaattctctttgttaggaggtggaatgaaagtgtccagcaaactccagccagcagcgttcgtcccttgatttagagggctatgatttctacaaagtggcccgactggcccgcgaacacgcagcagagacgcggcctccacaaggtcagaactaagatgtcctcagagatccccagttacgaagcaaagcgcgggcctacttcgggacctacgcgtccgggcgctgtgcgcggggaccgctcccgggcccagcgtcggggccgcggccttggggagccgccgggagccgcgaagcccggaagcagctgcaccaggactggaaggacccgcgggggcggtgccgcagctcatggggcggaccctgcgaatagaccgcccccgtataccccgcgctgtctgtgcgcgccggaccgccaaaccgagattagcaaggaccaggaccttaatataaacccagctccccattttcccgggtttctcatgcttccctaaactcggtcgccccctacagccccctgcccctgggttcttttccacatcccccaccactcctccatttcgcatccaagacttcatgaaaggctttcccagaaaagaaaaaatgaggagtcttgcgacttgaacagccctcccctgcccgtctgcaaatttgaattcctggatttcacaacagtgagctcttcttgtgcctaccacccggcatgagcaagacaagggggtgggtggtgggagagtggggaagtgtgggaaagaaaagtgtagacaaatgggtggaacaaagaagtttaaagtttagatttgggggctagagttctggtcccagttcaactaagtgtacaagcttgataatcgtgggccttcctatcacactggcctcttccagcaaaaccctacccattctcatctctagaggccttgacttcccttatcaccctgcattataatatttgataacatgggccgggagtggtggctcatgcctgcaaccccagcactttgggaagccgaggccggcggatcacctgaggtcgggagttcaagaccagcttggccaacatggagaaaccccgtctctactaaaaatacaaaattagctgggcgtggtggggcatgcctgtaatcccagctactggggaggctgaggcaggagaatcccttgaactcggggggcagaggttgtggtgagccgagatcatgccattgcactccagcctgggcaatgagagcgaaactgcatctcaaaaaaaaaagaaaaaaattgataacatggcactttccctctccagctgtgaactctttgagggttgggaatgtctttacctgtattcttggcacatagtatatggacttatgtttgtgaaatcagtgaattggctgtagtcagggaactcctcctgggggaagtgagacttgcacgaagctgggcaattcttggtccaggggggttgaaagaataggtgggggactcccaggagggtctgggacctgaaagtgaacccagattggcagggaggtgaccttatcatgccacctggagaggctgccccttctgactcaggtgggacttgcatgtggctcccaggcttctgtttggcttcctcaaaatagcttccagaaaagtgaataaaccacaaatggttgatttatttctgactctcagcccgtctctcacgaagacagagcctattgaccaaaaacttcaggatctgcatctgagcagatcccaggaaggggaagtcaaagggcccaggtcagaggcccaagttcagacttcagcagcagactagggtcagactttaccaaagtcagaactcgaggttcatgtaagtccttagatcccgctcccaagccctgtctttctcctccctccttctctcctccctccagctcagtgtggccacccgagggggtctctccctcccagccacagctcgggtatcccaagctgggaaatgtgtcactcggggctggggtgctgatctgtagcctagtccttcctggtccctcttgaggacagtggggatgggattggcacggccctcaccccggggtcccagccccattcctggctcccagccccccctcagcagcagtttgaagcccgggctggagatgggcaccccaagtggaaggttgggaggctgaggaccctgcgacagtgacagcaggtgagcagtggatgtgcggtggttggaatcttggaagtgggtgtcacagttctcgcagtactggagggagggagtaggagacctgcagagaaagaagaaaaagcattaagggcaggggaaggaaaaggggaagagttgaggcctcagagggggctggcagggtagaataggatcttttcagcttttctgctaaggaacaaattgccagctaggcatagtggctcacgcctgtaatcccaacactttgggaggcagaggcgggcagatggctttgagctcaggagtttgagaccagcctgggcaaaatggcaacgcctgctttttttttttttttttttgagatggagtcttgctctgctgcccaggttggagtgcagtgccatgatcctggctcactgcaacttccaccttagcgattctcctgcctcagcctcccaagtagccgggattacaggcacatgccaccatgtcccggcaaagcctgctttctacaaaaaatatgcttgagcccaggaagcggaggttgcagtgagctgaaatcacaccattgcacaccagcctgggcgacagagtgagatgagtgagactttgtctcaaaaaaaaaaaaaaaaaaaaaagggacaaattgccttccttcctacttaacagtgagggatccaggctggtccaaaggtggtggtgagttatctgaattaattgttcactcagttacagatcaaactccttactccacttttcccctccttctcactactgcacttgacttgtcttaaaaacaaatttctttaaaccattgtgggatccagagcagaatagttgaaagaaaaaaatggtaaccagacctagcaaactcttgggcaaggggagggacattagtcataatgactatagctaacattcatgtattgcatactatgcggcatgcactattctagcattttacatatattaacccattgaatcctaacaacaattcttactacccccatttctaagatgagaaaactggaacatgtagacattaggttgtttgcccaagtaagtggaatcaggctttaaatccagggagctcatgtttataaccacttgactatactaccctgtcaacctacacatgaggataaggaaagaactcttcagcactgtgctggggcgtctggtgtggtgtggctgggagaggcagaacacaatgagacatgggtctgagctaaagtttccccttaccggttttccgggctccttgtctctccatggctctccctgaccatgcgggctacctcagggaagccagcttcttcagcgagctgagccgcatccctgccactcagctcacagacccccacccaggcagccccacggcccaggagatagctcacagctgccccctggcccgctcgagcagcacacatcagtggggtccaccagaaggcatcccgggcgttgatattccccccagctcctcctgcctcatgcggttccagcagtctcctaagttctggcaggtccccctcctgggctgccctcagtatccggtgagtcatcttatcctcagcctcaagggatctcccttgtccatgtcttcctgatgctccttctgccactgcttctgctgctggtgccttcattattcttcttttctttctctttctttctctggcaggttcagtctgagatctctgggagtcaggagcgctgctctcatccccaatcagggcctcatagaaagctcgggctgcagccccatccagggtggactctggcttctcgggctgtggctgctgctgcccatccttccagaggtcgctggggtcagtggctggggtgaaggtgatgagcaagggccgggacatggcttttgggagaactgagaaaatgataccaggcaagggaaggatgagacaagtaagccaagctcgtggtgaccctgtagcaaccacagcctcagagacctgctgggatgagaaaaagtagtcaaaaacactttcctgccactaaagtaaccccacaacttaggactctgcagggcctaagggagagagactttgcgtaaaaacatggaaccctacaataccgactttgctccttagtaaagattaataaaactccatgagactgttgtccagaggtcctgcgtccggcccccacccccatcctcaccaacaataaacaccagcctctttctgaaaccactttcccaccccgtaagacataccagtaggaaaaaaaaatcagcctggccctttaagtcttccgcgatcccatttcggagtttcctcttcccaaacaaaaatagatgggtcactccctagaagatctcggggagagtctcctatacgtgttgctgtgtagcttccgtaccgcaaaatggcgccattctaatcagaagagttgacacaatcaaatagccacacggcacgaagacgcatgcgtggcgacaacaacaacaaaaaccacaacccacattacttgagggctcgggcgtgcgcaaagctccgggttcagtttcccgcgctggaactttttcaatagtaaacgagcaaagctccgcgcgcccaggtggcgcgagcactaggatctgtcggttggggtcctacttttacataacgcccccacaatgcccttcgccttcctcaacgtggcccccgctccaagcccattttctggagccaggaatccactctgtgggttaggaaaggccctcaggaggcggagggaaacctgtggaatgccgagaagccgtgtaatgaaataacgtcacgcctgcccctcaccattactctgaccagggttcgaaggtcacacttagagcctaaggggaaatggagaagtgcaaagggacgagcagaatggctggcaccacctcaggttagcgcactgggacgttccagttctcacaccgcccaccccaccccacccaagtccctacgcacggagccaagccgcacctctcccctcatgaggcaggagcccggaggaaacagtatgcccgtcaagggtctctggcgggactgattcgcactaggggcccaacaggcaataaggacccagcggattggccgaggataggccagtcccctgggcagcagcgccgcgccgggactagaggggaacgtgaggagagctgcggaaagagatccagcctggctccctcctttccccgccctaagtcagcctcttcacccagtgagcacaaaactgtattgcccagactcccgggccccgaacgccatacctggcttccgcttccggtggcttctcgttgtgccccgcccgcaagcgccctcctccgggccttcgtgacagccaggtcgtgcgcgggtcatcctgggattggtagttcgctttctctcatttagccagtttctttctctaccggggactccgtgtcccggcatccaccgcggcacctgacccttggcgcttgcgtgttgccctcttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccggtgagtctgaagtcgtcgctgctccgagtcccttgtcgctgggagcggcacatggggtctccggactttgatgtgggggcgggggaggaagcgaccaggtccggcacgaaggagggagaggtggcctgaggagcggaggggggatgtgtggattccggtgaaagggacctgacaatcgcccccaacccgtgagaaaaggaggagcccagttcttgcttgagaatgataaacttggaaacccttgggaaaggcgtgggggtcatgcagagacttgtattggtagggagcctgagtcgaggtccctgccggagttgacacagaggagagagggccctggccttcgggagctccagggatgtgggtcgggctggtgggtcaaagtatctgttggcttctttcaagtggtgggaccccaaagaatgtttaacttcaaagaaaaggggctgagatgtaaattagaggagctggagaggagtgcttcagagtttgggttgctttaagaaagggtggttccgaattctcccgtggttggagggccgaatgtgggaggagggaggataccagaggcagggaaggagaacttgagctttactgacactgttctttttctagctgacgtgaagatgagcagctcagaggaggtgtcctggatttcctggttctgtgggctccgtggcaatgaattcttctgtgaagtgagttctcttcaacctccctacttgccagcttcacatatcttcccaccagacgttccttcacatattccacttctgcactgttctcttacatgctatttgaaaacttcctatcagcaaagagtcccccctataaaccccgacgaacctgtgctaaagtggcaaaactggggcccaagtcctgagtctgccaccgtccagcaatataacgttgggctagtcaatttgtgtctttttcttttttttgagactgggtctcactctgtcaccgaggctggagggtagtggtgcgatctcggcttactgccacctctgcctcccaggttcaagcgattctcctgctccagcctcccaagtagctgggattacaagtgcctgccaccatgcctggctaatttttgtatttttagtagagacagggtttcactatgttggccaggctggtctcgaactccagacctcaggtgatctgcctgcctcggcctcccaaagtgctgggattacaggcgtgagccattgcgcccggcctgtatcttttgttactaaagtggcactgctagtacttgtctcaggtggcctttaggaaaactgaaatgctacacattgaaatgttttgttcagaaaccatgctgttcagcttccaccttccttagccagctgagaggacaaaactggttcctagagacgggatacaggagtggagtagggacaaagatcttgaaaagaatgtctaagaaaaagattgctgtatctacttatccttagaaaagaaaagccaaagcttttatgggagagagtgtaggtgaactagggagagacacaagtacttctgctgagttgggagtgagaaacaagcacaacagatgcagttgtgttgatgataaggcatcacttagagcattttgcccaggtcaaagatgaggattttgatatgggttccctcttggcttccatgtcctgacaggtggatgaagactacatccaggacaaatttaatcttactggactcaatgagcaggtccctcactatcgacaagctctagacatgatcttggacctggagcctggtgaggcaccctcagggttgttttgtgtgtgtgcgtgcactatttttctcttcaaatctctattcacttgcctgaattttgaaatttcctttggttctctgatttctttaaccccaaattcatgctttattttgatcctccacctgactcttgtctagttttgtgacgtatatcacttgttctcatgttttctaaatccgcaattcagacctattccaaaatgcgtttcctcatgggtctggtttgttgtctgtttctcctgctttgcaccttccagtctagaatttcatcttctgcattgacattgttgcagttatgtattgaggagggagttgggagggagagcaaggagcagaggctgaaaaggtgtgaagggaaggcagagctgtcttcgtttgatgcaagggtcagaagcccaggtttctgggtcccatgcccagatgttggatggggtaaggcccaaaagtaggtgctaggcaaactgaatagcccgcagcccctggatatgggcagggcacctaggaaagctgaaaaacaagtagttgcatttggccgggctgtgtttcagatgaagaactggaagacaaccccaaccagagtgacctgattgagcaggcagccgagatgctttatggattgatccacgcccgctacatccttaccaaccgtggcatcgcccagatggtgaggcctctctgctcctacctgcctccttctgagcagtaagagacacaggttcctgcagcaagaagtcatgtttaagccctgtttaaggaagctagctgagaagaggggaagaaccccagaacttgggcctgggaattgaattctgattgggggtcatcctgaagggattgttttcagggagggagacagaccttgaatcagagagttgtgatagactgcctcttcctcaaggaacaaacaacaaatggctctgatggtttgtagcctgcctaattggaagaaaggcaacacagaagtttgagagcccatctagtccagagaaggggcctctggacagaggtgggaggagtgggggacagagtggtatgggttgggctgcgaagggagttgcctcttctttacatctacctgccaaccccttccattgtattcacctcagttggaaaagtaccagcaaggagactttggttactgtcctcgtgtgtactgtgagaaccagccaatgcttcccattggtgagtgttgaagaagggaaaggaaagcaccgtgtggcagtcttatgggaaggagttggggctcaacacattggagcctgagtcctgaggggaggttaggtaggaatagggggatacctggcctgctgagtctggctgtctcccaggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggtagggagcagggagagtcattaagggtcaaaggaaaggcccaagatcccccagagaggggaggacagggcatggccctttcttgaggtctgcttctcccagaatcagggcatctccctgctgagtgactgtgggaaagttatttgattatctgtgcttgagttaccttattgtagaatgttcttgagctgagaagttgggaaccacgaggctttagctctgagcaggtccatagaggagctcaggtggggaggtgggaatgcaggtgactggcagggcctggatggggctcatgctgctgcctctctgacctctgccctggcctaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggccatgagctagtctgctggtgcttgctgttggggaagggaaggtgatggtgtgttggactccaggggccctcatggcccagcccaccctccccagattgaaaaccaggacagatttgtgctcagtggattgggtggtgtttttagtatggagcagaacagaattcctaggactgcgtgtgatgaaatgcaaggtcaaaaggaaaagacaaagcatatttcaaagatgagaaatatttgtttggatatctatgactgtctgtttatactgtaaggggcttaatcagcagctccatcttttagttttagttctaaaggaaaagtagcctaaagtcagtataactaaagggtggaacgaggtgggacaaggtccggaattgctgctcagtgatgtgtgtgtgcctgccgctggtggagctgagactgctcatctcagaaggatggggatgcttgatttcctggccaggttgtcccagcacagtggggattggccctgttgtatgacgaagacagcacatggtggcagagatagatactaacccatggactttccaagggagggaataggtctttggagggtatgcaagacaaaggtagacactggataaagaacccggtagtgcccaggtattaccccatctgggccattactcccacactcaggaaccagacgttgtgggtgaggacatgctgtccctcctgccaagtaataacttccttcccagccaggatcctgccccaagtaggaatatagctctgcatttacagcagctcctgctcagaccttgtcaaaaccaccctgcagcttaggattaaggagcatggtcacaggaaggtggggtttcagggcatcccctcaggaactgcccatctccccagaattccaaaatgaaggtccatatgcttgtaggtgtgctggtcatggtgggcttcacagtaggaaagggtaagtggggcccaggggcagggagggaggaaggggtaactgagtccaggaagggggtggagcgtggccatggataatcgggcttcctactggcccagggtatttgagagtgacccagtgcctccatccctccttctgcctccccagttcctgttcccgacatccggacgtgccacttctgcctcgtagaagacccttctgtaggatgcatttcaggctcagagaagtgtaccatcagcagctcatccctgtgcatggtgatcaccatctattatggtaaataaggtcccaggaaggggctgctggtggggcagccaatggcttggtcttctctcctctcacagatcagggctgctccgggcatggggtacaagaagagaggaggggctgagtgcaatggctcatgcctgtaaccctagcactttgggaggctgaggcaggtggatcacttaagctctagagttcaagaccagcctaggcaacatagtgagaccctgtctctacaaaaaaatagccaggcatggtggtatgcacctgtagtcccagctactcgggaggctgaggtgggagatctcttaaactcaggaggcataggttgcagtgagccaagattgcgccaccatgctccagcctgagtaacagagctagaccctgtctcaaaaaaaaccagaagaatcttggaaggaggggtctaaggttctagggggccagcagagctcacttttctagcctcttgaaggactctgggttagaagtaaattaggtctgggtgaaggatgggaaaagtcagtagcaggggttcttggactatgggaagctattggaaggggttatcagctttcccctctccctcagatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgtttttttgtttgtttgagacaaagtctcgctctgtcacccagggtggagtgcagtggcatgatctctgctcactacaacctccacctcccgggttccagcgattctcctgcctcagcctcccgagtagctgggactacaggcgtgcaccaccacgcctggctaattttttgtatttttagtagagacggggtttcaccatgttggtcaggctggtctcgaactcctgacctcgtaatctgccctcctcgacctcccaaagtgccgggattacaggtgtgagccactgtgcctgtctgagctctggtgctgttcttccccctagaaaagaatctctagtgtggattctgcccagacaggctgacctgagaaaggcacagtggttcctccattccttccccatcatctgagtgttccagtatcccccatccctctcaatccagtcacctgcctattgacatctagctctgtttcccctgtcttgtccatgtctctaagacccagtaccagactgaactagcagcaagaaggacgaggaggccgggcatggtggctcacgccggtaatcccagcactttgggaggccgaggtgggcggatcacttgagattgggagtttgagaccagcctggccaacatggtaaaacccgctctctattaaaaatagaaaaatcagctgggtgtggtggcacacctctgtaatcccagctactcaggaggctgagacaggagaatcacttgaacccgggaggcagaggttgcagtgagccgagatcgcgccactgcactccagcctgggtgacacagtgagactccgtctccaaaaaaaaggatgaggaatagaattctgtgcagatgtcctgacttggcaattttgtgtccctgcctcactgtctccaccaacccccgcctgtcctagtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggctaaaactgtgtcacattgtttgtggggtcaggctcaggtgtgggcaggtaaacacagattaaagagggttaatgcctggcgcagtggctcacgcctgtaatcccagcactttgggaggctgaggcaggcggatcacctgagattgggagtttgagaccagcctgactaatatggagaaaccccatcgctactaaaaatacaaaattagccgggcttggtagcgcatacctgtaattacagctactcgggaggctgaggccggagaatcacttgaacctggaaggtggaggtggcgatgagccgagattgcaccattgcactccagcctgggcaacaagagtgaaactgtgtctcaaaaaaaaaaaaaaaaaaaagggttagtgaggtttgggatccaaataggattgcagagccctctccattgcacttggcgtttgtcgcttcctctcggcctcctgtaaagggcacacatccctccccaccctctgcttagctggagatcaaagcatggggactgtgattcttcccagccttaaacataccctacaaaacctggaaagttagaccctgatgatgccaggtcttttcacctaagaaaagaaactttaggccaggtgcggtggctcatgcttgtaatccctgaactttgggaggccgaggtgggtggatcacctgaggtcgggtttgagaccagcctgaccaacatggtgaaatcttgtctctactaaatatgaaaaattagctgggcatggtggctcatgcttgtaatcccagctacttgggaggctgaggcaggagaattgcttgaaccggggaggtgtaggttgcagtgagctgagatcacgccattgcactccagacagggcaacaagagcgaaactctgtcttaaaaaaaaaaaaaaaagcctgggcgcggtggcttgcctgtaatcccagcactttgggaggccgaagcaggcggatcatgaggtcaggagttcgacaccagcctgaccaacatggtgaaagcccatctctactaaaaaaaaaaaaaaaaaaattagttgggcatggtggcacgtgtctgtgatcccagctactcaggaggctgaggcaggagaatcgcttgaacctgggaggcagagtttgcagtgagccgagatcgtgccactgtactccagcctgggtgacagaccgagactgtctccaaaaaaaaaaaaaaagaaactttctctttaaaccagaaagactcaggaactcagagccacatgccagagttacctgctgctggggccctggactcctgccattccttagttcttttcaaggattctggcatccaggatgccctctcgaggggcccaatttgaggggcaaagtgctgagagcactgatgttgggctgcagtggttggatcttcatgctaatattttaattttgaaatagtgcaaacgtatagaaagcaaggatggatacaacagccttttccatacactggataaacatgctggacataacgctgctctgagtcaggcttggtattgagcagcaggactcccagatgagtatagccaggtgtctgcccttccaagtcttgcagcccagtgcttgggttatgaaacctttttctgaaaagcagtgcagctttgtggctgggaggtccaatcccagcccctctaccacttggatatgtcagtctcttcagccccaccttggtcacctgtcaagtagggatagtgcctcagatgattgagaaaacacatgtaaatgtgcatacacaagtagaagttaaggccttttccccctcaaaaaaatatatttgccctagagtcaaatgcatacacaatgttcagcttttttttctaaggttcttactatgttgcccaagctggccttgaactcctgggctcaagagattcttctgcctcagcctccaagtagctgggactacagatgcacaccaccatgctcacctggctgatttacttattttcaaacctttttggtaaaacattcagaagcttgcacatatcacaagatggatttttgtaaaccacacatctgtgtaaccagccaccaaatcagcgtgaagacctttacctgcagccaagcctgcctctgttcccctctcccaggtgctcttcccagctctggggtagccgctgtcctgactggtagtagcttagatgagttctgtctgtgcttgatggaaatggcatcgtacgcatctgcttttacctatatagtgttttgcacacgtgttaacaaatctgtgtggcctgtactctgacggaaaataccaaaccaatgataattaagtcatgaggcagttggcgtacaaagagaggtacaaacccttaatgtgccccccaacccccaccttgctaagtccacccttctccatgacctctgacgtcagtataagacagagaaaggcccaggtttatagcaggtcaacctggaagacaccctcagaggctgaagaacttggcccagaattgaagagaccaggactccaataaggtctaacatctctttgagagtggccttctcggctcggggtgactcacgcctgtaatcccagccctttgggaggccaacgcaggcagatcacttgaagtcaggagttcgagaccagcctggccaactggtgaaaccccgtctctactaataaaatataaaaattagccaggtgtggtggcatgtgcttgtaatcccagctactcgggaggctgaggcagaagaatcacttgaacctgggaggcagaagttgcaatgagccaagatcacaccactgcactccagcctaggtgacagtgagactgtctcaaaaaaagagtggccttctcacccacctccttctacctgggcctggtcctttcgcagcccccttcccaccaacatagccctctaaacgcccctagcccccacacagctctggtctgacagcactgccgaggatgcccactaactttctggcattcaccataggagggctttcatttcctctttctctttttgtgtctagagcaaatcacataccaaggcaggacaagaggacagctcagcagagctgggggtcccttacctgacccatggtagggcagttaggcaggtgcacctccctcagccttcacctccaccagaagaaagagacataccaaacagtttacacacaaatttatttgggagaaacatccagggactaggggacaagagaggaaacctggtgggcagtagggctgggggtacagagtagcagtaagtgtgctgaagggcgtcaaccaagaggaagagccaaggctggggtccagtggctggagggaggcaaggagggctggtatgagggactagaagtcctggccaagcccagatagaagtcaggaaggtggctggaaactggtggaattttacaccaaagtttgctgcagtcacactaaggagtatagagccctctgttttgagggtcattgcagaaatccaggaagcagtattgagagaatatccagaagccagacaccggagaagttcgggtatttgaacaatcactcatctgctccttacttcggcagtcactcaccatgacgtcagaaccgctgcctggggagggacagtgggcaccagtgatacggaagtccccaggaagagccccaaatcctctcatccccacactcataagtcaaaaaaaaaagaaaaagaaaagattcctgtagttaggcatgggtggacatgcccagtgttcaccagccatggaactccactgaagttcccatgcaaggctggaggaaaagagccatatgaaatgtaatggttggagggggagttgggagttactgagccaagtgaggagaactagcaccataggaccatgtgagaaaaagctgggaaatgttttggagattgggtggcaggaaggaggtgtattgttatttatttttcagaccaaaagagaataagatgatgtctgctgctgttatacataatagagaaaaatctttgtgcctgcatcccaagaagtcatgttcagggatgtttgctgctgccctgcttgagagaaatgaccaaaatgcccatcaatagtgggatggggaaatcagctgtgatatgcgcatgctatggagtagtatacagcaggtcaataaaacaaggaagctgtttacaaactgatatcggaacattcagttcccctaacttaaatgtggaataatgtttacagtgggatgctactatcttgggttggggcgggggaagaggtgaaaaaatagtaaacagcatatttgtgcagggtggaatgtgcataaaagattgcaggagggatcatccagaaagtaaaaaaagtggtcacatgtgcaggggagccaggtgggttagggtagtagcgggagactttggtttgatggtattgtatactctgatatttgacccacatctgtgcatcggctatgttaaaagggtagtaagaggacttgaacacaggcagctgcatgcagtggttgttgagagcaccatctctggagccatcacaaattctggctcagcatctgtgagactcaggcaaggttatgacctttctgcacctgtttcctcatctgtaaaatgcacatagtaataatacctgcctcagcggattgcaagtgtttagaacagtgcctagcacatattatgtgttacgtttttgctaacttaagaaaggtggggggtcggtggaagagcaggcatcgggaaggagtcaattttcagcgagggagatgtccagtggtcaacgggatatgaggagagcggtttgacataacattcagattcagaaggaagtggtatgtggctgctggttgaagccagcaaagcagataaaatcctctgcttttgagtatatgaagtgggaagacagctaaggaccaaaccttggtgaacatgaaccactaagggtcagagagaaaacgctccatgaaggagactgaagaagccgtggaggatgcaggagaagagcaacaccagcagtaactgcagacagatgcggaagcagacagcttgaggacaggcaagggcacctggagatctggagggtccccgtcaaagctgcgcaccttgatagggtagaagctattcagctacagattgaggagagaaggttagtggaagtggagacagagtgtggctctgaagaaaagggaagagaggctgggcacggtggctcacgcctgtaatcccagcactctgggaagctaaggtgggtggatcacctgaggtcaggagttcgagaccagcctggccaacatggtgaatccccatctctactaaaaatacaaaaaattagctgggcgtggtggcgtgcacctttaatcccagctgcttgggagactgaggcacaagaattgcttgaactggagaggtggaggttgcagtgagccaagattgcgccactgcactccagcctgggtgacagagcagcaaaaaaaaaaagacaggattggagcaatgtcttatgggattatgggaacaagacttggggtgcagcttaggaggctgagagagtttccgtttgggagagtgctgggcccatgacaggagaaggccacttactgttctttttgtggagagtgatgcagctgctgccagctggggtgaggcagatgtcagatcccagaaggcaccctaactccttggtctccaagaggcatcggtagcagcgcaggtatttggggaatggaagtggttgagggggttcccaattgacaggaacaaacttacctagaacacagagaagtgctgaccccactcacaccccattctacctcacaccctaccactgcctgattccaggccactcagccccactcctccctcccttcctgtctcagaaaaccatcaaagccccaattctctgcttccttccccaactgcatacacatacatcccccttttcctctggtcctaaggccagaccacatgttaacaaatccccagacccagcagagcacttggtgttaggcagaggaaagtgctaaaccaacactttgaatcctgtgtctctgtggctggtgctttgcagccaagtggggagcccagcaggctggactcagtcttgttctatcctgtggattctggttttctcatccagcacactccctaaccctccctattctatgttgccctcagatccagagaggattccttcagtatctctattcaggtcactgctgtgaagtgagacagccctggggtggtcactagaaatctccttcagaggctgggtgcggtggctcacgcctgtaatcccagcactttgggaggccaaggcgggcaggtacctgaggtcaggagttcgagaccagcctggccaacatggtgaaaccccgtctctactaaatatacaaaaattagctgggcttggtggcttatgcctgtaatcccagttattcgggaggctgaggcatgagaatcgcttgaacccgggaggtggaggttgcagtgagccgagatctcgccactgcactccggcctgggatacagagcgagactccatctcaaaaataataataataataaatttttaaaaatcttcagattgcacatcagtccatgagcaggcattccctaccaaacccatctgtcccatctctcctcctgcatgggtttacctgagcatcctggacaggtgtacccagacacttggtgtctgtgggtttctccatccaggccaggagacccttctgaacccttggagccacttaccaaacaccaagctcatcatgaccagcactattaagaggaccgtgtagagggcttgggggctgctgtggaagcacaggggacccagactctggctccctgcagggcctgccataaaacgcatgactgcctgctggcctccagtttgggcttatattggtggaagagaggttggccaagaggaaggagagaggcaacaccagctcagggtggaaatcagtgccagaccagccagaggggcagaatgttcgcacccacagccactctggggcataacatcctgcttgagggcaggggaccagcaataggggaatgagaaaaggaactgtctttcctattaattggacagatgtttattgaatcactgcatcagatgctggggatacaaccctgcacaaagtctccaccctcacagggcacagtctagtaggggagacaagtccaccagcaatgatgtggggagggcagagtgctgccaggagcacctcgacagttaaaccactgaccagagggatttcggcagaggagtaacttgatcggatttctgtttataaaagattgccatggctgcacattgcatttgggtcaagagtggaggccgccgggaagtaggacgctattcccgagtccggtcacaagatggcggactggtccggcagaagacgagcagggacgaggaagcggggctaatgaacctgagatacagttagaagactggacagatttgctgttggactgaacgaggggtgagggaacaggggtaggcttgcacaaggaagtggtaccattttccaagataggaaacatgtggtctgtctcaaaaaaaaaaaaaaaaaagcaaatagggggtgcccagtcccacttctcataccctggggacacctgtcagacatcctaaaacaaggacacctggatcccaagcgatacgtactcagctcagtgctcccttggggttccaggaacccagcgccttccctcacctcatcctttttcctgccccgcctgtgctcagctgcggctcagtgggcctgaactccggagcccacagaatctggcgctgggcgtccgctctccgcgcctgaccgcacctcagaactccggtaggacgggggggtggccccccgctcaagctctgttccctggggaagaaacctggaaagtgcgaaccgcgcgtcgggacccaagcgtcgggccccagcggacatccggagcccgaagcggctccccaggaaggcggcgccgtagcgccactctccctcccaggcgaattctggagaccgcggccccaggcgtctcacccattttctccgctggggacccgctgggctccccatccacgcctactcggtccccaccccaccagctcagtcttgactcagaaactcagggtttttacttttaggatcgttgggctgtgcgttaggggaggaggtggtcctcagcgtcctggaacgacaccacctgctccaatttcccgtctggaggttctggtcgaggctccgaactcgggttccctgctacctcccagactattcaagaattatccagtcccaggatgataagggggaagatgggaagaaacagacgggagacgcccgcccagaaagactgcgggaagaaagaaattcgagaggaaactgcacgccactgagcgcctcccaaaagccttggaatgaatgaatttaaaaactatattagggccggactgcggtggctcacgcctgtaatcccagcactttgggaggccaaggcgggtggactacctgaggtcaggagttcgcacccagcctggctaacatggtgaaaccccgtttctactacaaataccaaaaattagccgggcgtggcggctcatgcctgtaatcccagcactttgggaggccaaggtgggggatcattcgaggtcaggagttcgcaaccagcctgagcaacatggtgaaaccccgtctctatcaaaaaatacaaaaacattagccaggtgtggtggcgcacgcctgtagtcctggctactcgggaggctgaggcaggagaatctcttgaacctgggaggcagaggttgcagtgagccgagatcgcaccactgcactccagcctgggcgacagagtgagactctgtcttaaagaaataataacacaaaataaattgtattagagaaaagccagagtagtggagaactgcagaggaacgcggggcacctacataaatgtcttgaatgaatgagtgcacagagtgatagacaaaaagaatcagagggccgggctccgtggctcacgcctgtaatcccagcactttgggaggccgagctgggcggatcacaaggttaagagatcgagaccatcctggacaatatggtgaaaccccgtctctactaaacatacaaaaattagccaggagtggtggcgcctgcctgtagtcccagctactcaggaggctgaggcaggagaatcgcttgaacccgggagacggaggttgcagtgagccgagatcgcgccactgcactccagcttggcgacagagcaagactccgtctcaaaaaaaaaaaaaaaaaaaaaaaaaagagagccaggggctcctcttgaagcgaagagggcaaagggcaaaggggaagcacaggggaacttcgcggcgccctctgaagctccctctcgaatataatcgcaacgaaaaggccaacgactagaggctttgcgaggctgaggctgggcttcgggaggggattgccctgagaggtccgggaggacttgctgtggaattcaagcgaccgtgggccttgagggaaccggggggcaagacacccacccagcattcgcggaatatttcctcgaattatttcggggaggggtgaggccggggcagggtggggccttcttcggagggggcgcggcctccgagtaattaatcccgtctttgttgcgttttgctcctctcctgtccacccagcagggccagcccagggcgcgctaagagtccagagagttcgtttccatggtgacgggttccgcgaaggttttcctggggtgaagaggcagggcgttgaataatcgccatggcgacagcagcagatgacggtgtcccttctgagtgctcctacctagagttaagggatacctgagggtaagcaaccgagtgacgaaacaaagaaggcggggcctgaggacagaacgccaaggttaggggaatggagccaggcaaacgaggggcggggctgtagatgacccggtcgggagagggccacggtttgttgggggagcggctcgagattgcgttctagagaggaaccagagagagggtctttaacctaaatataaatgaatgactggattcctgaagaatccggaatggcttgttgattggatagatggatggatggatggacggacggacggaccgatggatggaaatctggctatcactgacgcctgagctccccaccctcttgggccctccacctccggagccctcactcgcttgtgacagctgtacgagaaatacatgcctctcctaggagcaaaccctcaacccaaacaggcagcacagagccagtccagcacctcacactggaggcactcagggtggagcccaggtcgatgagacggcgtaggatgaggctttttggcccagctgggaaccacttctttccagatttcccgtccagagtctaactttcctttctcccagcgccatcttttctgctagtttgcccagctcctcagggtgcctggactttcaggcctcaccttgtgtccagtatagcagggtccagcgccccagcaactgggaaggtctgcatctctgctgatcatcccctggaactgctggaactttgctatatagggtgaggagtggacaggggcctgcttccacccctgggtggggattagttctgaaaacaaacacagctgctctgaaccttattgcatagggagtaatctgaagtaggctgaggcccctggatgggggggttcagaattcacatgttgagcctacctttctttccctacccaatttcaggtatctaagggcccctcaggtcatccactgttgtctacaattacatgcagtaagatgggggaaagtggcagtaggggcagttcagcagagtccctaatggccatgtccagggaggggtgtcctttgtccccagggtatgggaggtgagactgggcacccctatttgctttttttttttttttttgagacagagtctcactctgtcacccaagctggagtccggtggcacgatcacagctcactgcagcctcaacctaccgtgatcctcagccaagcgatcctcttacctcagcctccagagtagcttggaacacgggtgcatgccaccatgcctgggtaatttttaaattttttgtactgatggagtctccctatgttgccctgtccagtcttgaacttctaggctcaagtgatcctcctgccccagcctcccaaagtgctgggattacagatgtgagccaccatgcccagctcctctttgcatttaaggagcttcccttagctgaacaaaaatttagttttcaggggattaactcttctgttggatctgggaggatgggattcagaactgtgcagctggctccagagcttcatgttccacacttcccatcgtttgcccccctggaatgggatagaggagagggcaccagtatcagctatccacctgtttgctaacggtggagcattatggagctgtggtcacctgcctcttctaactccaaatttcaggcatcacatcacctgattaagtctcagatctccacttccagtggagactcagtatatcttcccttaaggagttgcagcgctaatgggggcacacacagcctctgccctggggtttcaagaagagcttcatgcactgggtttggagaagacacagaaatttagccagagactccatctaggacattagaacattgtcgcccacgttaagtatcttgctcaaaagaatggagttggccgggcgcggtggctcacgcctgtaatcccagcactttgggaggcagaggcgggtggatcacgaggtcaggagatcgagaccatcctggctaacacagtgaaaccccgtctctactaagaatacaaaaaattagccaggcgtggtggcaggcgcctgtagtcccaggtactagggaggctgaggcaggagaatggcgtgaacccaggaggcggagcttgcagtgagccgagattgtgccactgcactccagcctgggtgacagagcgagactccgtctcaaaaaaaaaaaaaaaaaaagaatggagtcggctgaggtgggtggattgcctgagctcaggagtttgagaccagcctgggcaacatggtgaaacctgtctctactaaaatacgaaaaatcagctgtgtgtagtggcacacacctgtaatcccagctacttgggaggctgagacaggagaatcgcttgaacttgggaggcagaggttgcaatgagctgagatcgtgccactgcactccagcctaggcgacagagtgagaatccatctcaaaaaacaaacaaaaaaccatccccaacaaaataaaacaaaacaaaaatggactcagggcgataaactttggggtctttcatctggaaaagagaagtttccaaatgaagaaagtggccagcggccaggcgcagtggctcacacctttaatccccaacactttgggaagccaaggcggttggatcacctgaggtcaggagttcgagaccaacttggccaacatggcgaaacctcatcttcactaaaaatacaaaaatcaactgggtatggtggcgcatacctgtaatcccagctactagaggggctgaggctggaggatcacttgaacctgggaggtggaggttgcagcaagctcagattgtgccactgcactccagcctgggcaacatagtaagactccatctccaaaaaaataaaaaaaactgccaggcaacaaaccaatgggtggaagagggatttattcactgtgttccacaaggtccaaagttagagatagatggcagttatagggaaccaatttcctcaggtacaacctaagcatcttctcctaacagagccgtccaaaaggcaaagtatggctctgagaagacatgagtccttggcacctggccctccgtccctggcagggcctgtgtttgttgaactgcaaaaaggctgtgaggacagagacttgatgacatggcaaggtgggtgtgcagggtttgctgcataagacgtggggagcaggcccttcctcactcttcaccaagataacaagaggtgagcaatgaaaattgggggtactgctagtaacaccatgcaggttgaacctggaaaccagcagaagcactgggtaggtgaaatcggatcctagaaagctcatgagccgtaagcaggagggggcaaccatgggctcctggggtggttgtatgcaggaagaactgaagaaggaggcgggaggggccagggaggctgcacagttgtgataacagtaggcacatcagggaccggggaggtttggggacctgctgcctgaggaaagctcaggttaggggctgaaggcctagggggacacagagatgggaagggttagattagctagattgtctagagttagggtttcccaaagcccagctctttggggcctctgctctccccactacctgcccctggctccctggacacttgagaagttatacaattagcctgatagtagaaaaaatacctttttattaattattaggaataatccattcatgtaatgcaggatgtatgttggagaaggttaagtacagccacatgaatgaggggaaacgtgcaagaggaacagtggtgagaagggggatggtcccccactttccacaaactataaacagcaacatgaacacagagaatcacaaataagagggtctttcctcatgtctcctctcaccccattcttccataatgagtcccagttggtccctagaggtgccagggcatctggaagttctgggctgggagtggggtgcagtgagtggcctcaaagttgtgcagatgcttccgagcctgaggaaaggaggtgggacaggtggggtacagagcactgttgggaggggcagccactggactccctccccaccctccacttccgcatccaccacccactctacaaaagctgccacttccaatgcttatagggtatccccagtccccctatgtgagccctggccattcaagaacccttcccacttcccactccttagctcaccagaaacaaagccagctgccgccgtccatctgcactcatgtcctcccctgcagagaggaggcgctcaaaataggccacacatctgggtattcatccccttcctaggcccttcccaccctctctcctgccccaggagctccttacccacgctccaggggaagtcgggcccgtgttctgcctggtaggagcggaggacagacagacaccagtcctcttccacctcccatcggctataaattgaggctggtcagggagagagatgacagccagtcagcaacctgaccttgctgggcccccgccccaagcctcactggatcccttctcaccttcctccagctgtgaggaggcctccaaccactgcctcaccactcgaagaccctcctctgccatcacccggggatacctacggaggaagtgccaggacaggtcagggctgattttttttcattcaccatccctgaaccttcctccctccttccctgtgctggtatcagtatctgtgtgtgtacactgcccccagcgcgcacacaccctggctctcaccgatgctgcaggagcttcagcaggaggtcattgcctcggttggacatgatgtcctcaggaaccctgggggtgagaagaatgtaccctggaggggctggaggttaggaggaagggtctagatacccaggtttctggtgggcagaggtagaagggacaagttcctggccatctctggggttcctgagggccgagattcccacgcactcacgtggtggtgatgatctcatccttggttctccggatcagcagtacaggaccctggtatcttcagagaacagagcagtgggaagggagagctcagagggagacgggtgacaactggcccacccctatccctgcactggtagcattcttaccctccccttgctatagcacagcccttgacctagcccttcactcaggggtgagaggggattatttaaggggcatggttcagtctggccctgctgggagacccctgccgtgccaggccttaaccctttggttgccagatcctgaggtggtccagagtcccaggggacctgggaggggttaggccagttgaggtggtggcagggtcactcaggatgtgagccagtggccttttaccaacttgcactttagtactagtttcagggtttgagcgcccagcagagctgtatggggggcaggtgttcaatgccggacgctggccggccctcacctgcacagctgctccgcgttgtttagattgagatgctgcctcacggtcctggtcaccaggccccctagagtgggataaaggtgaagggatggcagagacaaagcccttgcccaacataaaggtcctcactattcacggagaaagaaaactgaggcccccagacaaaggagtcctcctgcttccaacaatggggcgacttactccccacccaagaaaagggagccatctcagaacagttcccagttccagcccaccccttcccaggaagggcaggcctgggagctgcactcactccagctgtctggcatgaccttcaaggccaagggcaccaggtcatcaaaggaggcatccaggatcatggcactaacatctgggtaggacatggctgcccacgtggctggtaccagggcagggaagaagagtaagaactgagaaaggctcctttctccccaccacccatgctctcatcccactgaccctataggccaaccccattccccctatgttatcccttgtttttttcttaacctacttcacttggttagggaactatctggagaggatggggatagaacactggagatagtgcactgaagataatgggcaggaaacattcactttccctgatctccccacccaggacctgggtctgcttttccttttaatgactgggcacaagaggggaaggaaaggtgaagtgtatgcaaataggatagcttcttccaggcccactcagagattctacttcctctctcttcttccttgagcctccaccccaccccatttccccacctctcccgggtggggctgggtggtcatgaatgtgtctacagtgggggatgggagggaggctggtaccagtgaagccgccgatggaccaggcgtagatgatgatgtcctggggctggaagcctaggcggtggatggcaaactggaccaccacatccatggcattagcctcattctgcgggaatggcaccccctgcaggagaaagggcaaagtcaggagtgtgtcagcaccaaaggccagctcacctgtccctcccaacgtggacccctcctgcagccacctatgacaggcagagaaggtgtagaaggaagggatggtaggagaggttgttctctccagaagacggatgtgtacaatgagatctacctcctcctctcctgctagccccgcactgtggggatgggggcatggctcccaatgctgccttcacaacctcctagaccccagccctcaggtgagtgggacgccttcaagaaatccacagcccctctcctccctccaatggctgaccagagggaaacagacataattcaggaaaaggaagggattcctgagatggtctcaccgtgcttccagcaaagcctggatgattccagcccaggactgaatatccagctgtaacacagggggaggagggactgagaccttgtggcccacagccctttctccatccctgggggaaggaagagcagaagtaccccccagcttagatgcaaataactccaagccttcccagaaataggagatgacaccagaggttctgaggcagcacagggagcagcatgtgattgtgtggggtgtgtggtgggggaatggaacagaatgaaaagcataatagctagggacacaggccaggggagggatgtaaggttatcaaagcaaatggcgagtggacttttccctaaagctgagagactcaaaacctcacccagagaaagcagaggccaggggaggtcaggtcagtgtgggaggcagggacattccctttcaaagggcggagataaggaggctgagtcaccgtcctaccttccaggggcgtggagacgcagcccacctcataaaacccagcattcccctcacagcagatcacctaggaaggaggcaggaaggaagggctggggggccaagttgggactgaaaaactccctttgggcagggagggcagcccatgaagagctttgcagggaagaggaaagggcaggtttctgttttctccaaggggaatggaagcttctcattccacagggtccataagaggagaagcaaagggattacaaatactcctcagaggctgacctgctcgaccacccagccatgtcttttccttggaagattaccagctggatctctttcaggaaggggactatggagatgtttttcctttctcgttttcgggtctgttatcttctgtgaccattgctattgtgtggtatgctgattgctctccctatccctctctgagctccagtcttatggtcagataaactgtaatgccatggcgccccaagctgaaacccacgaatggtgggatttgcatgaactctcataacagatgggcagagccaggactagaacccagctccctagactcctggcttagcgctctttccacggctgcttcatggaggtaggagactttgaggccaggctgcctgggtccaaataccagctctaccacttactgtgaggtccaggaaaggttttctgtgccccagtttcatctcctgtaaaatgggctaatataagcagtacctatctcacgggattcttttgagaattaaatatatatgcttcatatatatatgagaattaaatatatataagtgtgaagtgctgtcaaagtggtaactattaatattagtttctcgtccttgaacgtctctcctacttcatctgtttctctatcacagggtttcactacatcacaaggtctttagcgtggagctaggacatgagattatccccagtagtggttccttcagggaggtgctatagcattggggtccccagacctctactgccttcctcacactcaccccacctctgggctctctgctccctcttaccagcttctgtccctggggctcagctgtcccccgccggtccacaaacatggtgtcaatctcattgccatcacaggccagcagctttgcccggcgcccattacactgagtacggaagacgcaatggccaagatgcaagggtcaggaggccacatcacaggggtggggcggggtgggtgggggtgagaggggagggctttaggggatgtgcgggcagggaagcctcacctcttccaccagtcgggcctggccctgcagcagcacaggcatgagggccttctgcagcaggtacacagagcctggatacagcatccggcgccctagggtgtgcgccaccaggtagctgtggggaacacaggttaacaaaccccaaccctgttgaggcctggggactgtgctggggaccatcccagccctagcactcacagactgtaaggcctgctttacccctgaccttcacagctttactttcctctttcaagccttaatgaaatatgtaccaggctagtgttttgcaaacttttcttactgcaacctttgtaagataaacattttatattgtggctcagtgcacacatatcctgtatgtacagaattctgagagttttatgatgtaactgtctatacataataagtaaatgcaaagttatcatcagattatgattctgttaaaatataagtacaacatattaaaggtccccaaataaataatgctttaaaaaatgatggttataattcaaaacctcaaatatggcttgcctccctgactaattagcacactgtcaacaaccaaccactaagtccaccctgttccttggtattctagaagctgcctcctaactcccagcaaaagaaaattcccagtgtctgttccactataagatataggtggttatttccgttccttctgacatcatcagtacccacgactgagctttatttgggatttaccatgtgctctcaagcacccaggcaaggcaggagcccttcagaacatgttaccttacttaatctcctcagcaaccttgcagggcaggttcatcacaggtgcagacactgaggcacacaggggcccggagccaaggtggaataacaacagggcagaggggccacgatgggtacacagatgctaccagagcctgccctagctacaagtgtgtgtcctccccacccccaccccacccccactgctccttttcagcctcactgaaggagcttttgttcatatcccagttctttacttactacatttgagactccagacctctctgagcctcttttcttcaaacataaatatggataaaaatgactttgccataaatgatctacacaaaccatacagcactaggcccaatgagtgacagctattttacaatggagcgcccactcccagagcactcctgaaatggcccctccaccccagtgggcctctcctcgctgctgtttcccacctggtgatctgacaaggcagcttcttaacccggttgaggagggtgtctgctgtcccccggtgcaggggctctgggcgaagcagggccacaccccggcgggaagggccccctcgagactccttcctgaggaagggaaagatgcagggaaggatagggtcaggagcagcaagctggatgtctgaggtctggagaacagtggggtctaggaacgacataatggcattggaaggcaggcactgtgacctgagagggcatggaggtgggagggcagagcagagattttctggaatggttctaaggggagagatacagcaaaagaactggggcctcaccggctgctgggttcttcccagtggaagtcgactggccagctccggaagtcaaagttgtagttggcaagctgcctctgcagtgggcacgagaggcaaaggggtactgagaactcaggggaggctctcctacccaccctcaacaacaccttcgttatccaggggtctgatccccacacatcatggggaaaccaagcggaggtcaataccctcccaattctcagatggaaaattctaacaggaccagaaaatcaggggagatggtatgccccatcaggtatcaggactggcctgtctgccctcttccaagctaagaacctaacactctgcttttctaaaaaactaagtctgacccatccccaggaggagtggctgaaggtgctagtgcttttgagtgacgggtagtaggggtcgctggctggtcacggtctattccccacctgggtcccttatagggtgctgtcttagaagcttagaaatctcccagcagatcacactgacagacccaaggttgagtgagacagagaggagggaagtcacgcccacagtgggctcctctgccatgtggggccacccgttgaaggaagctctgacttccatcctcacaactacatcccttcctcaactcctgcagccatggatcagtgttgccctacagcccatccgaacctcgggccaccccactgagccagtccacatgcctttttttttttttttgaggcagggtctcgtgctgttgcccaggctggaatgcagttggtgcaatcatagctcactgcagcctcaaactcccaggcccaagtgatcctcctaccttagcctctggagtagctgggactacagacatgtgctaccatgcccagctaatttttaaaattttctttagagacaaggtcttactatgttgcccaggctggtctccaactcctgggctgaagcgatcctcctgccttggcttccgaaagtgctgggattataggcatgaaccacctcaccagctccacgttttttgacggcagtgggagctgtgtctttttttttttttttttttttgagatggagtctcactctgtcgcccaggctggagtgcagtggcacgatctcggatcactgcaagctctgcctcccggcttcacgccattctcccgcctcagcctccaagtagctgggactacaggtgcctgccaccaccatgcccggctaatttttgtacctttagcagagatggggtttcaccatgttagccaggatggtcttgatctcctgacctcgtgatccacccgcctcggccttccaaagtgctgggattacaggtgtgagccaccgcgcccggcctagctgtgtcttaatacttgactatattcgtcccccaccccctgagctcctagcactctattttgagggtttttattttctgcacagaaattttttgacatttcaaaaataatttgactaacagagagcaatagaaaaattatacaaaaaggtaaatggcaaaacaaaacaagatgactaaaagcaaatttcaggcaggctttgctcagacctgctctcaaatctggacttagccactttcttgctctatgactccgaatgggtcacttaacctctttttgcctctgttttctcacatttacaaataaaggtaataatgccacctcactcagctgttgtgaggatcagaaagggtgtgtgccaaatgcttcagccagtagcatagtacagggcatcattacgcagctccatagtgtggagtagccaggaatgtgatgatggtggtcatagctgtttgatcctagaaacctcccataacagaaaagagctctatggggccccaaagcccatcctcaaagataatcacagtccagcaccagccggcttggcataattcccaagacactgagccctagcttttctccctcctggcaccatgctgtactcccaggcataggagtggacacacctgtccaccttgtcccatccacaaacaaggatagcatggtattcaatgcatacaacaaaattaaacatttatagaactgagctgctgtgatacagagaaaactaccttctaagaaacattgtgggctgggtgcagtggctcacacctgtaatcccagcactttgggaggccaaggcaggtggatcacctgaggtcaggagtttgagaccagcctgaccaacacagctaaaccccatctctactaaaaatacaatattagctgggcgtggtggcgcatgcctgtaatcccagctacttgggaggctgaggcaggagaatcgcttgaacccaggaggcggaggttgcagtgagctggaatcatgccattgcacgccagcctgggcaacaagagcgaaactccatctcaaaagaaaaaaaaagaaacactgtgggccaggcacagtggctcacacctataatcccagcactttggaaggccaaggcaggcagatcgtctgcagtcaggagttcaagactagcctggccaacatgatgaaaccctgtctctgctaaaaatacaaaaattggccaggcacggtggctcacgcctgtaatcccagcactttgggaggccgaggcaggcggatcacaaggtcaggagatcaagaccatcctggctaacatggtgaaaccccgtctctactaaaaataaaaaaattagccgggcgtggtggcaggcgcctgtagtcccagctactcagggggctgaggcaggacaatggcatgaacccgggaggccgagcttgcagtaagctgagatggcgccactgcactccagcctgggcgacagagtgagactccgtctcaaaaaaaaaaaaaaaaaattaactgggcgtggtggtgtgcacctgtaattccagctactcaggaggctgaggcatgagcattgtttgaacccgggagttggaggttgtagtaaactgagattgtaccactatactccagcctgagtaagagtgagactctgtctcaaagaagaaaaaaaaaaaaagaggccaggagtggtggctcacgcctgtaatcccagcactttgggaggctggggcaggcagatcgcctgaggtcatgagttggagaccagcctagccaacatggtgaaaccccgtctctacaaaaaatacaaaaattagagggtgtgggtggtgcgtgcctgtaatcctagctactcaggaagctgagacaggagaatcacttgaacctgggaggtggagagtgcagtgagccgagatcgtgccattgcactccagcctgggcaacaagagcgaaactccatctcaaaaaaaaaaaaagaaaaagaaaaaagaaacattgtggaatgtttctagtttagccagttcttacaggtgagggagggggaagattgttctagcagaatattccattagaagtggtagggaggaaaaattcctcaggtggacagttcactaatggaggtgagaagggatacagcaatgtgcaagcaaacacccagtgtggtgggtggtaaaacacacctcctcttcctgcagaagccagtgtctggtgctctgagggacaactgagaaagctgctattgggtgcctgtgtggcacttttcctagggcctctcaccttgttttctgaagactggttccgatgtgttgcttccaagatggtgatgaactgccggtactgggggttggtccagcggccaatgcctggtagaaaaaggacaggaaacagtgctaggaaaactgggaagcagaaagcctaggttttaggaaaagaattggagatgggctagaagaaggccctgtaagaaaaagtgaaagaaaaaggaactgagggcataggatgcggagaaatagatgtgagccaacccccttcctccaaatccagcaactggctacaggacgcttcttctccctagcttctgcagtttgtgtctttatagacaatccttaacctaccatcttccagaatgttcctcttcctcagtctttaaacactgtcatataacctattaaatgacactattaaacactatcatataatactattctcccttgcgaatatcaaatttctctatttttcactgccattcttctccaatgtttgctttctgcctcttttctgtatattctagccccttgccatctggcttcagagtctccgactcctgcccataattacttcctcactgaattcctgactcttctatcctcattctcttcaactgtactactcagcattctccctgtccctcaagattcttcctgcctctgcttcctgggcccatccttgactccttccagttcctgaacagttcctctcctgcctcctttctgctttcctttctgaagcagaagcaactctcagtgctgactctctctcctctctcttttcacttacacagtcagtgattgcatccactctcctttcactgctgagccacctcaaaccctaacttctctcctcactgacttggcaggtgtcgtgtgtcagacaggcaccgtactacacacgggagactcagcaggaaatgagatacacagctcctggctctcagagagctggcattctggttggggttaggtacagccaggagaagacaataaacaacatttcagagagggataagtgctacagagaaaatacaacaagaatgaaccagaactttatgtgtcatcaatggtattcccccaaaacgatatgatgagagaatgatgtgtgctgcagaatgatttgtacaacatttatgccaaaaatgtaaaatgtgcaaaataatacatactgcttatagataccatatttcatagattctaaaatgtatattttttaacccttgaaaactctgaaattagaattcattttacaattgatggcagcttagacttgaggaactgaggtatatgtttcataaaagtatgtgccagaaaaaaaaaaaacccacaccaaatgacaattattacttctgaggaaagaggaagatgggactgaaaggattccaatgggaactccaaccctaactgtggtgctttagtattttgttgacagaaagcatttaaagcaaatatcacaaaactatatataaaaaaaaaatcacaaaactatacatcaaaaaatttaaaaaggcttttatattttgttctctggacttttctgtattttttcttttttcttttttttgagacagttttgctcttgttgcccaggcgggagtgcaatgatgtgctctcggctcactgcaacctccgcctcccgggttcaagtgattctcctgccacagcctcccaaatagctgggattacaagcgcccgccaccatgcacagctaattttttctgtattttttctaaattaaaaataaataaaataaaaaactaagacaaaactgagcagtgggagctacttttagacagggtggtcagggaaggcctctctgaggagagagcccagccctgcagagatcagggggcagaacacctcaggcagaaggtcctggacccaactgcgaccatccagccctgaccccaccacccccatgttgaagcatcgcccatcacctggttgtcatcttatgtacccactaggggtaggtgatctgtcctctttatttttttaaattgcgagatacaacatatgtacataaaacatatattcagtttaaaaaatacaaagcaaacattcatgtgactatcacctaggtcaacaaagagaacacagccacctctcagcagggctctcccccactctgttctcccccaccccaggtaatcactctcctaacttttgagaaaaccatgcccttgctgggcgcggtggctcaagcctgtaatctcagcactttgggaggccgaggcgggtggatcacgaggtcaggagattgagaccatcctggctaacacggtgaaaccccatctctactaaaaaatacaaaaaaacctagccgggtgtggtggtgggcgcctgtagtcccagctactcgggaggctgaagcaggagaatggcgtgaacccgggaggcggagcttgcagtgagccgagatcgcgccactgcactccagcctgggggacagagcgagactccgtctcaaaaaaaaaaaaaaaaaaaaagaaaaccatgcccttgttgtcttcggtgttctacctcaaacatgcacatcccttttgaattttatataaatgaaaacatactgcatacattattttgtggttagcttcttctatttaacacaacatttgagaaattcatctgcattgcttttgtttatctggagacagagtctcgctctgtcacccagactggagtgcagtggtgctatcttggctcactgcaacctctgcctcccaggttcaagcagttctcatgccttagcctcccaagcagttaagactataggcatgtgccaccatgcccagttaattttttgtattttattttttctgagatggagccttgctctgttgcccaggatgcagtacagtagcgcaatcttggctcactgcaacctctgcctcttggattcaagcaattctactgcctcagcctcccgaatagctgggattacaggtgctcaccaccatacctggctaatttttttttgtatgtttagtagagacggggtttcaccatgttggacagactggtcttgaactcctgacctctggtgatctgcctgcttcagcctaccaaactgctaggattacaggcatgagccactgcacctggcttcatctgcgttgttgagcgtagctacagtttgttcatttgcattgctatatagtgttctcttgcatggctattgcatggaacttttttttttttttgagacggagtcttgctctgttgcccaggatggagtgcagtagcgcaatctcgtctcactgcaacctttgcctcccaggttcaagctattctcctgcctcagcctcctaagtagctgggattacaggcacgtgccaccatgcccagctaatttttgtatttttggtagagacggggttttaccatgttggtcaggctggtctcaaattcctgacctcgtgatccactggcctctgcctcccaaagtgctgggattacaggcatgagccaccacacccggccacacagaacatattttatccatcctactatttgtagccactggagttgtttccagcttaggattattacaaacaatgttgtatgctgtattcttgtacatctatattgtttatacatgtgcaggagttttcctagtatgtatacatatatagaattgttgtagggtatatgcatcttttctagataaaagcagccaggcatagtggctcacatctataatcccagtacttcgggaggctgaggtgggaggatcactttgagttcaggagtttgagaccagcctggacaacatggtgagaccctatctcttaaaaaaaaaaaagcaaacctttttgttacttttcagttattttttcatatttataacccaagtcttttaaggaaaagatcatgccttaaaccattctcaatgattccctctcggaggcccatcactaaaatgtatttgcacaaggtacttaatttttaaccagtgacagtgacagataagattcaaaccaggtttcctctccacctacctcggaggcaggccacacctgccagaagtagcagcaatgtcccagcatagtgagaaaacggcaccactttggacaaactcaagtaacctgggaagggagagggacaatgtgagaccctctccgcaatgtccctcagctcctcttcccagttcagccccaacctccaccccacactccctgtttggaacagccataccctaagaggaagaagatgcctgatggaagagggaagccaagccatcttcacaggtcccctctcctctttagggagctggctcatctgccaacaacctgcccatttgctaccccaccacctttgaaaccacactgacctttcctgtacaagtagaagaaggcgaagggagaggagtaataagagatggaccagaatactgaagcctgcagcagagagacagggacaggcaatcaatacacacacacacacacacctgccattccaggcatatactatacactctgagcaagatggacaacctgagggatatcatatcatatttggtgtatgacaccatgaatacagtaggtgctcagtatttgttgaaaagtagtgtgtcaatgtaatggaggctgggaaaatttggtacaggctctattttcttcctctggaattatggaagaattatgtcttccatctccagacataattccatcacatttaaaggcagtctctctgtctactcaagttaatcaagccttttcaattggccctgctcaggacagcccctggcctggtccccaagagatgcgcaaacgtcaccacaggaactgtgccagaaagaacagctgtccctgcagccaaagaggttagttgccagggaggacaggtcactggggaactgcaggacttagcacctgcagatggtcccaagagtaaacatgttttccttacggctcaggttgcccccagagaaagcagtgctacataccaaaggggagtgccaagtatgcacatttagagtgtgcctgtgtgtctgtgttggagaggtctgctgcagagcccagggcatcccccaaccccagggcactgttgctcccaagttagggagggctaagttcaagaggacaggtgggtctgaaagatgcagagtcccagatgccagggtagacataccagtgccaggatgctgtcagcatgtttctccagggcacggggctgatagtacgtatcctgccaaaacagatggcctccttaaggaccctgcccactggcaggtcctttcccttccctttcagaagccctgctgtgtgtcctctggttctagtctcgttgactatctctcttgaaacatccctggcccccacagaaactcctcttcctcaccctcactctgaacctaatttcccacccctgaccatgggaacaaacacagggagctggatttggaagcaaaagtgaaagcagcattggacgatttttgctccttttccacagcctagtttcaaatggattgcaggcgcgtgcatgtggggagaagggttagtttgagaagaaagaaaagacacctagacaatctaagaaggaaagaaaagcatcagaaataagagtagttgactaagaagagaatgtgggtaggagcgggcagtttgtaggagacagtaacacaatgagacaactgataaaaaggaagagaatatttagaacagcctaccaccacccgccagctctccagaatacaatgactcgggtctccaggctaggttgggcgggggttgaggggaggaccgacggatacaggatctgtaaaagtcattctgaaattcaaggcgagggtaaagggaagataaaaacagagccgggggaggcatgaagaggcactgaagaagaggaaactgggagtctgacagcaaaattcaacggctccccagtccgcgcagggtctcttcccgggactcaagactcaactgggaccggcacgaaccacgacacacagggtcggggggacgcggagaggaaagaacaaagagtggcagtcggaatgagaaagcggtaaagagcgaaaaagaaaggaggcggccagtccgtaggcgtgactttaactcaggaagcacacagagcgcagattttgcggataactggcttgacaagcaggctccccttatttcccattatgggcacttctggggagcaaaaggccgtaaagggtttggactgtaccacgttcttcggtggggaggaactcgactcacccaggagctggaatggggggcagtgactgccgttggcgtctcagggacgctggccggggccctttcagagtccctctcccggtagattttgtagagccgggggcctaggacgcagctcagcagcttcgccatggccccggctcgggccgctgctcttccagcagcaggtccccctgccggccccgccctccctgcctctgaggtgttgtgtgcccttgacgtcagcccgtaccggctccgcctccgggcgagttgcgacattttcagtgcttcctgagaagagtttcgcgcagttggagctacgggtacagcagtggtccgaaactagtggaagaccactagaacgcggagaatcagaaaattaccgggcatggttcaataatttttttctgtctcattattggcagactctagagcgacagcggaaacgaggggtgagattaggagtacttgataagagtaaccgaaaacataaggtgtctaggaatgtatctagtacaagaaatgcaaggttttatgaagaaaactataaaaagttattgaaaaggcaaactggcccggcccggcgcagtggctcacgcctgtagtcctagcactttgggaggccgaggcggggggatcacttgaggccaggagttcgagaccagcctggccaacatggtgaaaccccatctctactaaaaatacaaaaattagcctggcatgggtggtgcgcgcctgtaatcccagctactcgggaggccgagacgcgagaatcgcttgaacgcgggaggcagaggttgcagtgagccgagatcttcccactgcacttcagccttggtgacagagcaagactctgtctctaaataaataaataaaggtaaactggcccagcgcggtggctcacgcctgtaattccaacactttgggtggccgagggatgattgcttgcgtccaggagttccaggccatggctcatgcctgtaattccaacacttggggtggctgagagaggattgcttgcgccctggagttccaagccagcccaggcaacatagtgagaccccatctctacacaaaataccaagggggaaaaaaaaaagacctagcagggtgtggtggtgcccacctgtagtcccagctacttgggaggccaaggtgggagggtcgcttgagcccgggagtttgagatcgctccatgcactccagcctgggtgacagagccagaccctgcctcaaaataataacaataataattgaaaaaataaaaaaagaaagaggtaaacgaaaagcttttcaataaatggaaagctacaccatggtcctggatacgaaaattcagcacagtaagatatgcggaatatttgtaaaaagaaaataaatgaatcattactgttatgcatgaactggatcttaaaaccatgatgctgagtgaaaatagaaagccacagaagaatgtatacgtgatactagtatattagattcaaaaacacataaaatttaatgataaagcaagtggagaagaaagagaaaattcagaattgtggttacacagcatagaggatctctgactgaaacggaatattctttttttctgtttttttttttttttttttttgagacagggtctagctctttcacccaggctggagcacagtggcacaatcacggctcactgccctgatcctccacctgctgggctcaaccatctttctgcctcaacctcctgagtagctgggactataggcccacaccaccatactcggctaattttacaaggtctcaccatgttgcccaggctggtctcgaactcctgggctcaagtgaacctcctgctttggcctcacagagtgctgggattacaggcatgagccactgtgcctggcctggaatattctatttctttttcttttttttttttcgagaccgagtttcgctcttattgcccaggctggagtgcaatggcccgatctcggctcaccacaacctctgcctctggggttcaagcgattctcctgcctcagcctcccaagtagctgagattacaggcatgtaccaccatgccctgctaatttttttatttttagtagagatggggtttctccatgttggtcaggctggtcttgaactcctgacctcaggtgatccgcctgtctcatcctcccaaagtggtgggattacaggcatgagcaaccgagtccggcctggaatattctatttatttatttatttatttatttattatttatttatttttttgagacggagtctcgctctgtcaccaggctggagtatagtggcatgatctctgctcaccgcagcctctgcctcctgagttcaagcgattctcctgcctcagcctcctgagtagctgggactacaggcatccaccaccacactcagctaatttttgtatttttagtagagacagggtttcaccatgttggccaggatagtctcgatctcttgacctcgtgatccgcctgcctcagcctcccaaagtgctgggattacaggcgtgagccacggcgtctggcctttattttcagagttggggtcttgctctgttgcccaacctcaaacttctggcttcaatcaaccctcccaccttggcctccaaaagtgttaggattgtagacatgagccaccatgcctggccaggcttcttttactctcattatattgtgagattcaactttgttgcaaatcactaggtttgttcattctcattgctgtccagtcttctactctgttaagcatttatccattatatagttgtacttcatatagtttttggtatgtatggaatatttcatcaaaataattttaaaaataaataaattacacattaaaactgtaataactgcatgaagatctgccttaggagtttttgccgttcagaaggatgaatcagcccgttagccttgtccctgagtaataatttaatacacttattagggtttcaggagaggtccggggtatgccagacaaccacagggaaagtcattccaaatcatttacgggacactgactcgatacacagtcttgtgctgggttctgtggaggaccaacataaaaactcaaactcagtttcttcactcatagctgacatttcttttcttttcttttctttttctttttttttttttttttttttttttttgagatgaagtctcgctctgtctcccaggctggagtgcagtagcacgatctcggctcactgcaacctccacctcccgggttcaagcgattctggtgcctctcagcttcctaagtagctgggattacaggcacatgtcaccacgcctggctaatttttgtattttttgtagagacagggtttcgccatgttggccacgctggtctcgaactcctgacctcaagtgatccacccaactcatggctgacctttcttaggagtgaaagagacctcagaatgtacttccagactgacaagagctagacaggcaggaccacttctctgcatggttttttgcatggaaagtctttatttgagccccttagctgatgtggaatcagaagagcaaaaaggtcatcttcagagtggcctgggctgggtccttttctctccaggatagaaaagtggtggtcactttatccctagtagacatgctgctgggctttatcgccccagcattcccatcccctccagagccccttgtcactccagaccagcgagtgtgggcctttatctggactctgcttcctccctggggacaccaggtcttggagcaagagaacttggcaggctctccccatggcagtcttattcctcctcctgttcctatgtggaactccccaggctgcaggtaaggggcaagaggtacgggattccttagctatttgcaaggttggggagggactactgctctttctcctaggagcctggcgaaggcatctgactcaagaagatagaattaccccaaccaacctcctcctgcctctgacactagggaagacccagaggcaacgagggtccaggttatgcagtttcctttataaaataagaagaatgagtaaatgcttccagaaaagtagaaatgagtagaagagatgtgggcatttgccaactttcagccttttccctcttgccctcagaccccctcactggctgggggagagaggaggaaagcccttaccctcttctctccacctgtcttatttttgtagctgtcacttgagaaatgtggtcaccagccaggcctgtgctgggggaccccagaagggaaggaagccagggttgaagatcaaatggggggttattgatctgatggaggtctctggcctcatacaaccctcttcccacagacaacatgcaggccatctatgtggccttgggggaggcagtagagctgccatgtccctcaccacctactctacatggggacgaacacctgtcatggttctgcagccctgcagcaggctccttcaccaccctggtagcccaagtccaagtgggcaggccagccccagaccctggaaaaccaggaagggaatccaggctcagactgctggggaactattctttgtggttggagggatccaaagaggaagatgccgggcggtactggtgcgctgtgctaggtcagcaccacaactaccagaactggagggtgtacgacgtcttggtgctcaaaggtgagtgggggcatgcagaccaggggctactgtggcccaggaagtccaggtgaagaactgaggaatccctctctcccctacaggatcccagttatctgcaagggctgcagatggatccccctgcaatgtcctcctgtgctctgtggtccccagcagacgcatggactctgtgacctggcaggaagggaagggtcccgtgaggggccgtgttcagtccttctggggcagtgaggctgccctgctcttggtgtgtcctggggaggggctttctgagcccaggagccgaagaccaagaatcatccgctgcctcatgactcacaacaaaggggtcagctttagcctggcaggtaaactgaggaaggagacggaaagggatgttctttcacttcagcctcccaagtagctggaattacaggcgcccgccaccatgcctggataattttttgtacttttagtagagacgagatttcaccattttggccaggctggtatcaacctcctgacttctagtgatctgcctgcctcagtctcccaaagtgctgggattataggcatgagccaccgcacctttaaattttttgtagagacaggatcttgctatgttgcccagtctggtctcaaactactggcctcaaatgatcctcctatcttggtctcccaaagtgctggggttacaggcatgagccatcacatctggctattttttcttgaaagaaagggtgaattactataaagggtgtgaggggaaagtgtggttatggctggtggtctgctctgtagttggttgcccatgcgtgagcagggggcattgccattctctactttttattttattttattttattttattattattaggccaggcatggtagctcaatcctgtaatcccagcactttgggaggccgaagcaggcggatcacttgaggttgggagttcaagaccagcctgactaacatggagaaattctgtctctactaaaaatacaaaattagccgggtatggtggcacatgcctctaaccccagctactcgggaggctgaggcaggagaatcacttgaacctgggaggtggagggcgcagtgagccaagatcacgccattgcactccagcctgggcaacaagagcgaagctctatctcaaaaaaaaaattgtatttttagtagagacggggtttcaccatgttggccaggatggccttgatctcttgacctcatgatctgcctgcctcagtctcccaaagtgttaggattataggtgtgagccaccacgcctggccttttttttttttttttttttttttttgggatggagacttgttctgttggccaggctggaatgcagtggcacgatcttggctcactgcaacctctgcctcttgggttcaagctattctcccatctcagcctcctgagtagctggactacaggtgcctgccaccacgcctggctaacttttgtgtgtgtgtgtgtgtttttttttgttttttttttgagacagagtctctctctgtcgccaggctggagtgcagtggcgcaatcccggctcactgcaacctctgactccctggttcaagtgattctcctgcctcagcctctcgagtagctaggattacaggcatatgccaccacgtccagctaatttttgtatttttagtggagccggggtttcaccatgttggccaggatagtctcaatctcctgacctcgtgatctgcccgccttggtctcccaaagtgctgggattacaggtgtgagccacagcgcccggcctcttttttgtgtttttagtagagatggggtttcaccatgttggtcaggctggtctcgacctcctgacctcaggtgatccacccacctcggcctcccaaagtgctgggattacaggtgtgaaccactgcgcctggcctcaatttttatactttcagtagagatgaggtttcatcatgttgaccaggctggtcttgaactcctgacctcaagtggtctgctcgccttggcctcctaatgtgctggaattacaggcatgagccactgtgcctggccgccattctctatgggtcagggtgagaggcctggaaaggggcagagtagggtggaggatattgtgggcagggaagcttacaaagtcttctgttggaagagcccaccagactgtggaggggaagcctctctttggggcacagggacagggcccctcactacctccctcccatccctctggtctggcccttactacagcctccatcgatgcttctcctgccctctgtgccccttccacgggctgggacatgccttggattctgatgctgctgctcacaatgggccagggagttgtcatcctggccctcagcatcgtgctctggaggcagagggtccgtggggctccaggcagaggtgagtccctccctccccggggaaagaagagggcacatgggtgggaggcaaagggctaggctcacaccccgcctctgtaccccacctcctctaggggagggggcgaggaacacggctctaagttgtctgctgacttctcttctgtatccctgatggctccttctccccagatgcctcgattcctcagttcaaacccgaaatccaggtctatgagaacatccatttggcccgtcttgggtgaggaacagctagggaacagaggcttaaatcctggaggggactggggatggagaggaaacacgggttgggttggggatgggccctcgttcctgaggatgtgaaaagtagaggtatccttaatctgtctctctggaaaaccccacagcccacctgcccacaagcccaggtgattttggtgacatctgctgggaagtgtgacctgctgtctcgctggccatctggcacctggaagattcctcgacaaccttagcaaggggggcgggactgagagttcgacttcaccatccagctggcctccagcagccaccaagctgtgtatggggaggggtgggggactgaaggaaaggaggagcattattctgtgatgtaacctacaaaaaggtttggtctcctgtcttgtagcagcagtggagggatggccctgagcccatagtactgtggggttgaggggagcctgaggttgctggtgggggcaaggaggatgggtgtgcacagggaggagacaggaatctggagacttgagcaatggtgaggaatccattgcagtggagctgaaggacaaatggggaaaacgggggaagagagagaagggaagagactcaagtcagagaaagtggaaagagatggacagagggagaaaaatagaagcacaaagtgggaggatggagggacagagaaaatggaaagcctcaacccatctctaaattaagccagacccccactaccccatgtctcatcctcacaaagaagagagggaacaggcatatttaatcaaccccagacttcctcacatgcaaggggagggaactgagtcaggatagagatgcctgtgctcagctcccacccggggccccctccttatccttccttatcctaggcacacactcttccctgtggcgccttaccggggcattcagagcatgtgagcagctatcgccactctggcacttccttcctgctgccctgaggtcacaccctatttctcgggggcagagggagtgtctactcaggctggcaggcccagtgggggtatgttatttattgggccggggccatgctgggatgtctgtgaaccatgggcgagtctgggctggtgaagcgagggaggatattgatgctcccaacttggccattccctagtctcaggcagaaatgagctgagctccagccacaccctcacaagcagctccactgggtgcccttttgtgtctctgctcaagcttgggccttactggaaaaaagctttctcagaagtctcacctaaaggcttcaggctgcaggggcttaaactaagccattggcaagaaaaaggacgaaaatgacacagatggagaatgaggggagtgccgtggtccaggttccagctccagcccaacccaccaagcagctacagtttgctcttagagcacacacacacagacacacacacacacacacacacacacacacacacacactgcagtatctgcagtattactggactcctagatagaccttttattaaaggtactcttcatagtcccccaagccctccatcctgagttcccgacctaccacattagtctttcctagcaagactctcctccttaccatacctgatgctcctttgatccccttgcctgagatccacagtgtcatcaaaatgcctgccttgccagtgacctgggctgacacggggcatcagcaatgggcatctagaaaagacaaaagacgcagaataggtgttctttatgaggttggactctgggcaggtgcctccccaggccttgtgaggggtctgtgaggggtctgctgagagatctggggtctctgtacaaaattaggttctcgggcatgtctcaaagtgtctgtgcaggtgtttccagggccgcagtgatggcggggggtatcctgggttgggggctgcagatccacggaagctagtggaggaggtgtcctctcccagcgaagctggccacaaagaggggcagggaggcgaggaggctggtgagctgctgtggggaagcggctatgttgcacaggtcctgctcgcagcagtggtgccacagagtgtaggagtgcagccagtaggtggcatagcctggcagagggcactgggcccttgagaggcagctttttcactcagtgatctcactctggtctgtgggatgaaagaggcatgctgaggcgggggccacaggaaaggccggatggatggaggtagggagcctcctggagaagggccattggaccagagtcctacctgaagtgccaatactgatgccacaagcttcatcgtcccgacactcggtgggaacagggtggcagggtttggtgaagccacagatgtagcagcggagccttccccgggcaggggacatggtgagacctgttgaggcagcagagattaggagagcaggagaggcaaaccctccctgtggggcaggcagaggccagatccggagagggatcacagagagaggtgacacatgaagcagagagaggaaagctgtggaataagggaggaaagctgacagaagtagaaaaaatagctgggcgcagtggctcacgcctgtaatcccagcacgttgggaggccgaggcgggctgatcatgaggtcagaagattgagaccatcctggctaacacagtgaaaccccgtctctactaaaaatacaaaaaattagccgggcatggtggcacatgcctctagtcccagctacttgggaggctgaggcaggagaatctcttgaatctgggtggctgaggttgcagtgagccgagatcatgccactgcactccagcctgggtgacagaacgagactctgtctcaaaaaaaaagagggagacgatgcaggaaaagaaacagagatggaggcaagaggggtacagggattgagagatgcgcagacatgaacagaagccacaagaatcagagaccaacataaaaagagtgagacaaaaagccagacccagcagcagggaagttgagggggtcagtgaaaaagttaagtaaatggcaccagagacagataggaaaatagaaattgacattgaccaaagggcccagcacagaagcaacacgtgaaataagggataggggagacaggggcggatcaaagatgcagcaagggggagacagttattctcaaatgccttgaaaggaaactcttcctttcccacctcatcaggctggccttcccagtggctggtctccctgaagtcccccactcccccagctctcttcttggcctcttccagcacccacacccctctcctccccagccctcaggttcctccacatgcccttgtccccacccccagccccctgaccactgaaggttccccagcccacccttacccagtgccccacagaggaacagcacgcagaggaagatgctggaggtgcccatggccagacacaggctcaggaatctgggagaggtgatctgcaccccgagatcccgggatttgtagagttggagcatttgagcaagacagtgaggaaccagtaaacaaacacacctagggagtgaatctggggggcggaaccatgaccagattcaccagcctgacccagcaggcagcgggggcccccagcctgcccctgcaaggagtctgcccttgcctggagggtctcctctgctctctcagcatgttgtctctgtaacttagcttcctctcctgctcctgagttgtgtctgtcgccttccctcctactcctccccctccctccccatgtctcaagctgctccctggctctctcagcttctctctgtctttgttttctctgtctttccccctcagtgctttcatgtctctcaaagtcaccctcctaaacagccccggcgtggatctgtttgagtgtagaatcaacaatacccccacccacacacccacatgcacacacaaagcccagctgtgtaagggcggaccccacccagcttcagatccctttgatccccccaagcttcaacattcctaccctgtaattatccctgccagctttactaccttggaggaaagaaataaccacgggtggggctggagggcctgctgatgtgcttgcactggggagaaatcactagaaaggaaggcatggatgggatttggggtaggggggtggtgatacagcctggaaggctggggttgaagagactgggaaggaggaaggcccatctggggaatcagagccagcatgtaccaggaggagtaagactaggaacagggagtgaagataggggagacacaggtgcccaggagagcagctcttttcaaaaatattgatctcaggacctctttacacttttcaaagttacttaagactctgaagagcttttctttatgaggttatatcaatatttactacattaaaaattaaaacagaaaatttaaagtaggtatttattgatttatttaaacaataaaaataataaagtattacatgctaacaaaatacagttttgtgaaaaataactattatttctccacagcacagtgagaagctgagcattgctttacatttttgtgaatctagtgtcaggcttcgtgggagatgcctgggttttcctatctgcttctgcattcagtctgttgggatatgttgttttcgttgaagtccagtatatgaagaaaatctgaccttacacagatagttgcaaaaggaggaccctcaaggaccctgtgaaagggtatcagggatcctcaggggttcttgttggtccacagactgctgctgaggataaaggagtttgaggactccagaggatgctgagagcatgctgtggggcccctccctgtccccactggggcccttggtgcctgctgggggagactctttcttccttttttatagccctataaagctcaaggcacgggggatataaggcaggcagagccgggctggggaggggggtgggcaggaggtagaggcggtcctgacacgggcagactgcgatgaaaccccagtttgttgggatcttgctcagctccctgctaggggctgccttgggtaaggaggcggccagctagcttctcacacaggccttctgccagccggctccaccgagggcccaggtccagcgcctcttttctcctgccaggaaaccgaatgcggtgctacaactgtggtggaagccccagcagttcttgcaaagaggccgtgaccacctgtggcgagggcagaccccagccaggcctggaacagatcaagctacctggaaaccgtgagtcctcagtttctccctcttccagcagcctttccctgcctccagccccatgtcaatccttctggcttccagaaccctccaggctcagtctggctctgggcagatggtgcagctgttagaggagagcagtctgtaccccttctggctcctggcacggagcccctgagaggcccacagtccttgtgcccccacttccccacctccttattctcctaaaagaatctcataggcccattagctcacaaatgaagagctctggccctgaaaggccaaagttaaaaccaaacttcaaattttcggcattagttaaggaccagggaggggtgtgtgtgtgtgtgtgtgtgtgtgtgtgtgtgtgtgtgtacatgtttttaatattttattttaacataattttggattgacagaaaagttgcagaaatactcaacttctcctaatgctaacatcttacataaccatagcacaattatcaaaatcacaaaataactgatacaatactactaactaatctacagactttatttgatttagcaagatcctacattgcatttagctctcatgtcttcttagtctcctctgatctgtgccagttctgtttttctttgtctttcatgaccctgacacatttgaagagccctgataaattattttatacctggagtttaaaaaattacttttagggccagtgcagtcactcgcacctgtaatcccagcactttaggaggccaaggtgggaggaccacttgagcccaagagttgagaccagcctgggcaacatagggagaccctgtctctacaaaaaacaaacaaacaaacaaacaaacagattaaaaaattagttgggtgtggtggcacatgcttgtagtcctagctactcagggggctgaagagggaggatcgcttgagcctgggagattgaagctacaatgagccatgatcacgccactacactccagcctggggaacaaaatgagaccctgtctcaaaaataataataataataatttttaggctaggcttggtggcacacacttgtaatcccagcactttgggaggccaaggctgaagagtcacctgaggtcaggagtttgacaccagcctgggcagcaaagtgagacccccatctctacaaaaaatgtttttaaaaaattagccaggcatagtggcacacacctgtaatctcagtttcctgagaggctgaggcaggaggattacttgagcccaggagtttgaggctatagggaggtatgattgcaccaccacactccagcctgagtgagagagcaagatcttttctctaaaattaaataaaatcatttttagattaaacaaaaattacgtgccggatgcagtggctcacgcctgtaatcccagcactttgggaggccaaggcgggtggataacctgaggtcgggagttcaagaccagcctgatcaatgtggagaaatctcgtctctactaaaaatacaaaattagccgggtgtagtggtgcccgcctgtaataccagctactcgggaacctgaggcaggagaattgcttgaacccaagaggtggaggtcgcggtgagccgagatcacaccattgcactccagctgggcaataagagtgaaactccgtctcaaaaaaaaaaaaaaaattacagatacttgaaatactaaaaattattttatagaatgtccctcgatatttatttatctgatatttgccatgatgagattgaggtcatgcattttaagcaagaatactgcagaagtgatgttgcatccttcttgctgcatcacatcaggagtttacaaggtcaatgcattaactttgatcacttggtttcagggaggtgttttttgagggggctgaaaatccctttgggctccttgaaatcacatctgctctgccccagaaggcaagtcctgaagccaggagtccaacaccccagtttcattctctctctcagccccagtgaccttgattcaccaacatccagcctgcgtcgcagcccatcattgcaatcaagtggagacagagtcggtgggagacgtgacttatccagcccacagggactgctacctgggagacctgtgcaacagcgccgtggcaagccatgtggcccctgcaggcattttggctgcagcagctaccgccctgacctgtctcttgccaggactgtggagcggatagggggagtaggagtagagaagggaacaagggagcaagggaacaagggacatctgaacatctaatgtgagaagagaaacatccttctgtgagtcattaaaatctatgaaccactctacagctgactggaaaattacatctatctttggttgatgggagggctaaaagcgtaatatggggcatccaggttctagtttgggggttaccaagcaacagcgggcttaattacagtggtgcactccttaaccaactaaaccccaaagggcaatggcttatctgccttctgtggctcctggatcctgttgctgggttgaatcttccttagcaatgagattcattgagtggggttgccagggttttgtgagcctgagtctgggtttgctcccctatttcccatttgcaagttggctcccaataggactattttgaattgagaaaagaaatgtaaaaactgtgataggtaaaaactgcttgatgccctacttactaactaggctaggtgaggcctttgactctaacctgagagaaactgaagaaacagggtctcaggccccatctccatgtacctctcctatcctttctggagagccctcaagccaggccgcaccttcttcttggcaatacatcaggggtgtggcctaaatttaggatatgagttgttgtgtgccacctggagacactggaagggaggatgaagacctgaaaaacctgtttctccattttccccagcccagcctcccagggaacctccctgaaggattcctgtgtaagggagggagattgagagtattatttcctgggaggtgacctgacccttaggtcttcttataataaatgtacattttatcagactcagacatttattactcaaaatggaaagaggtgagtatgggggatggggtacatatgggagcctgggtttggggagtcagctctgtacagtgaggtcatcaggtccttgtgggagccttcactggggacaacacagaagccccatttcaggcccagatcccaatccctcctcaagtaggggacagcagagtataggaagcaaagtggggagcccttctaggagccaatggaggtcctggaaggaagtgggaagggacccagaaaaaggagagtgaagggtgtgaggtgggaaggatggatgaggagaccactcggaacagtgtttaattaaagaaatgggagctagggagagacgattctgtaaagccaggggatacagagacacagggagagaggctcaggccaaggcaggtgggaggaggggcagccaatggaatgagtctcagtgcagcagccagaggccaaggccagccaaggaggtaaggaagacaaggcccagggctggagtgggccggggtcctgcgctgttgcagttgtccttgttgcagcaggtggtgttatatgtcagacccagcttgcggttggtttggttgaaggcctcctgacagggctcttctggtgtgccacagcgcagattggagaaaacccacatcttacctaggggtgggaatgggcagggaatcggccaggatgggcacctggcatgcctgtgtccacctccccaccccatccacccacctaggcttccttccttcccaactctgtccctggccctccccttctcttttcttagtctgatcttccttctgcacatccttacccaccactcccccagtcctggttctatcacttgctggccatggacctgttactgtctctgttttttgtttttttgttttttccaagacagagtctcactctcgcccaggctggagtgcagtggtgccatctcagctcactgcaacctccgcctcccaggttcaagcgattctcctgcctcagcctcccgagtagctgggattacaggcgcccactaccatgcctggctaatttttgtatatttagtagaaatggggtttcaccatgttggccaggctggtcttgaactcctgacctcaagtgatccaaccaccttggcctcccaaagtgctgggattacaggcatgagccaccatgcccggctgtgttactgtctctttttgaggccgttttctcagtataataatagcacccacatcacagggttgtcatgaacattaattgaaaaaaaggcatgcaaagacataggatgttgcctggcacacaaccatctttggccaaatattatcattgctataatcctctgcttctccatctcagtcttagacccatttgggcctcagtcctggtcatagaggctcccacctccctgttcaccccactaaggaaggggatgttaccaaggtatgcatgtgttgtcaggcattgctgtcctggctccaggcggcaggactgccggtccacacagcccagcacagggaccttgtagcaggagtgacagcgaatgtcagctgggaagacacaagtcaggctgaggtgatggggtctctgacttacctggggataagctgagctgggggcaggggtggagggtggagaagagcccatcccgtaggtgctccaacctgtttggctgtttggtctagcaagcacagagcaggtgagtgatgcagggaaaatggaaagtgggcggcaggtaagggtagagctgttgctttgtgaaaggcccacgccctacatatcttccatcactccaccccgtttggaggtgagtcaagagggacagaactatgaagaaaaacatggggctggagatagatggaatgtgaggaagataccatggggaaagaatgtggatggtgaaggaggagatggaaacttgaaagaaggagaaataataaaaatgaaaatcatgagggttacaacactgtcagaaatgccttggaacttgaggctggcgagaaagccatctgtggccagctttagcaatttacaatttactcttcacctcctggagctggcaagagtgtggcaagaggaaccagacctgaatagaatcctctcaccccagtagctcttcagcagaaaggaatgatacctgagagacagatcaccagattccatcttagcaccttatcaaaatggagagggtggatacagaaggtggcaccccaagtttcctgcttcagttaattcaaggtttgggcaggcaagatttggtgacgcagggtccgagggtggaagagcctggtaagtgtacctcagtgaaatccacttcaccctggaggtaagtggcccagttgtcccctcttcagaaggctcaagaaaacgctctgtttccatggaggctcttagatgtcactgcaaccatctagaaagtttgtatcccctgtatgggaggaggtatgcaacccaggaggggagtagggggtatctaggaaaggccatggctgagagactgaacatgtgagtccctgatggagtagatggggagggtaggttacaaaaggagcctggggctggatgcctaggtcttcgagaggacaccttactgagcacagcagatagaggagaaggcaggtaagctagactctggagagttgcatattgaagtggggctggttggggaactggataccagagtttccaaggaggagacaccttggagtggggaacaggggacccagagccctggcaggtgagagaaatgggtctttcttggaggtggggaggatggatggagacctggctttttgagaaatagagcaaggaggctgtcatagggaagcctggtcttggtggcacaggagagctgagccagttggggctgggggtgttgggatcccgagtggtgggtagggccgggaagtgggtagagcagggtgtaaaggtcctgaccaggcaaaccaggtctttggggcccccaggtgctcacctgagacccagcagagcagaacagacagggtgagcagcataagggctttcatggcgagggtcctgagaatggtggcaaccacagcagctgatagagtagattttcaaggatccagctctaggagttgagtggcctttttggaatttataaacccaaaggctcctcccttccctgcctctggtagcccctcccttctcacttactacgcagctgaccagagaaaagacaaggggtgggaaggcactgagcaggactgagtggggagtagggatgggagagagggatgggggaaggcaggtgccactagtggccaatgccattgtggttcttggtttcaggccaagatgcccttcctggtccccagctaagagtcctgctgctcagtcctctgaatgagcatcatcaaaggcctctgtgatttacagtgtccatggtggcagcttctgctggttcctggaaaatggacaaaaggatgtggcccaaattaattgctgaatttgggtccctgggtccctgctgggcattgataggggcatgctggtggaaattgggggaggaatgggtcaaattaatctccattcagcccccactcggtctttccaatgcctgctcagcaataagtgactcactgatggcttctgtgatgccacagcagcagaggcaggggctggggctactcatccaggagagccaccacaggtctgctaagtagggctgcctcaggctcccatgaaggttctcaggatgtcacccgtgctccacttgcgcttggtgtggccttgttgctccagtccagcagcagcaattgtcctaggtgtggctgtgtgcacctgctccaaagcacctccccagtcaaaacctgccaacttgggcagggtaccaagccaggaggaacagcatgggcacagagaggtgaggtagaagctaaaataagaatagaaatagtaggccgggtgtggtggctcacacctgtaatctcagcactttgggaggccgaggtgggtggatcacaaggtcaagagatcgagaccatcctggccaacatggtgaaaccccatctctactgaaaatacaaaaattagtcaggtgtggtggcatgcacctgtagttccagctactcaggaggctgagacaggagactcacttgaatccaggagccggaggctgcagtgagtcgagattgcactccagcctggccacagagcaagactctgactcaaaaaaaaaaaaaaaaaaaagaatagaaatagtaataataatggcaagcacttacatagtgatcctatgtattctaagcagtttacatgtattactttatttcgttatcacaatcccctacaaaacaggagttttttttgttgttgtttttgagacagggtctggctggctctgtcgcccaggctggagtgcaatggcctgatcacagttcactgcaacctcgacctcctgagctcaagcgatcctccctcctcagcctcctaagtagctgggattacaggcgcacctgaaaagttaagcaggccaaagcatttgtgtaaatggcccgagcacacattttaagtgagaaccatttgaagactccgagtttgcctgcgaggattcccaaagggatctgggcagctggtggccccgccccctctcttatcggagccccccagcccctccgttctccccacgcctaacttccctccggtccccccccaaccggccccacgccgctgattcgctcgcagcttctcctcaccacatcctaaccatggctgtgtttctgcagctgctaccgctgctgctctcgagggcccaagggaaccctgggggtaagcgatccctgggagagttgtgatagacgcagaggggctgaagcaagataagggccgcctagtagggtgggttgtgtgtgggaagatccaggatggctggagtgcagaacagagaagagaaagaggagacgggatggagggtcgtcttgccctgtggacgtgccctaaccacagcctccggcctctcctagcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggggactcgggcacttttttctgcaagggccgccacgaggacgagagccgtacagtgcttcacgtgctgggggacaggacctattgcaaggcccccgggcctacccatggtaggtgcaggcctgtgcgcacaagggtacttaactccgacacatacccggaggagggaagagggccttggctgggggttcttgagcgggactgctggctgtccctcgtcaaacccctgacctcagcatccctccccgccacgcctttcccccagggtccgtgtatccccagctcctgatcccgctgctgggcgctgggttggtgctcggactgggagctttgggcctggtctggtggctgcacaggtgagcaggagggacccggcctcgttaaatggggagtgaccagaggtggaaggggcaggaccagaaccttcgcaaaagaaagagctagacctagagctctggtcctggcttggcgaagaatgggagaggtcaaaggtgggagcgaggccgctgactggtgagtagagccccaccagagcagatgagctggaagtgcagcagagttagagcctgggctggactgtcggtggggtagagtctaagttgtttccggtctgagccttcaagttgctgggctgtccttggcgtggcgagtcccaggagaaccagtgagacaagactggtggttctcaaagactcatatgtcccttacaggcgcctgcccccgcaaccgattcgaccactccctagatttggtgagactaattccaccccattttctttctcctacatgcccactccccacccctcaattcctgagtctgagcccttgctgggagcagacacgttggtcaccttctctccatccttcagctctgtcccccccacatagctccacttgtgaaaaccgagccccagaggccagtaaaggaggaagagcccaagattccaggggacctggaccaggaaccggtaagggcatggggatgggaaggggatagccagaatctctgaggaaaatggaccaaaaaaaaaaaggcctgaaccccaaggaagactgtggagaccatcttgtcttcctccccttcctcctccagagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtatagaaataagtgctagactgggagttgggagacctgggttccaggctgtctctgccactggtcttacttctaaacttactcccatctctcctataacctccatgtctccctcaccaccagtgtcctctctatacccaatcaagccctagctccttttttttttttttttgagacggagtctcgctctgttgcccaggctggagtgcagtgacaccatctccctcactgcaagctccgcctgccgggttcacaccattctcctgcctcaggctcctgagtagctgggactacaggcgcccgccaccacgcccagctaattttttgtatttttagtagagacggggtttcactgtgttagccaggatggtcttgatctgctaacctcgtgatccacccgccccggcctcccaaagtgctaggattacaggtgtgagccaccgcgcccggcctgattctttaagctgtttttctttgttgctggtgttttctttttggactcctcttccttgctccatatccctacagtatttcccaccattctaggtttgtccctttctcttcttctgggacactctcatcaacagtcagtcctcagccccctcctctgcaaatgacactcagaactctctctggctcagatctcagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcgcaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaatgaatgtccctggaagtgtcatttctttttctttatcaaataggggtggactggtaatctaccagtctctgaatcatctaacatttagataaattcagtgagcaatccacccatacactcttttctctgccctggacacacttcccatgatagaaattctgtcttgttcatcttgtgctcaagtacctatgacatggttgggcaatgagttgataagtacctaacaagatttttgaataagaggccttcttccctgcactgaccccaaactcaggtttcagccctgccctatccctttgccccagtaagacaccagtcacagcccagtctaaaaggtcaattctattttattggttctgagagggaggattcacccagtggatccttttccctacactctcccctcccccaatattgaggctctctcccaactactgcctattcagcattctctatctaaccctccttccccttctacttcctatactatcctacccctggccagcagtaccccaaggccaggccctcagctgtgggggcgtgtgctgagcaccaagcagagggagctgagcccggcgccagccttctccagttctgagcaggacacaggtaccagggtgacatcagagagcttctgcagtgcctgcacagggaagacatggagtggggagaggggagtgagacctcaggctgagccaggccactcttccagccagctcagagtggccccacccaggcttctagagaaggtacccttccttcctcccactaggaaagcctgaaactcttttctctgatggtgcttggtgttggagttcctgccctctctcacctcctggctgttgggcagatccccacctccacggtgcaggaggaaagggggcacaccaggcaacccaggacgaagaaagagacagtcagcagctgcgtcatctgggagggtcagggaggcatatgggtgatctgtcagcactgccattgcctagaggaaagaggaagtgttcgagtctcagaacctctccacagctgtgtctgcctgctcaaccaccactaagggctggggacggactgacatttgtggaaaataatgacagcaagcacatagagcttacgatatgtcagacactaagtactttagttacctttgctaatttccaccttggaatcacatgcagttattttcaaccccctaccttccccagcccctcctatctgtcctacccatccttagagtcacagtttaggtgccacctttggggtttcctgaaactccggaagagcaaattaatcacccctgttcccagtcctgctgttgtaacttcttattttctcctgtgttctttcatgtaagatggacagcccattgagggcaggggttagggctaatttcctaagcctcccagctcccggcctcccgggcccagaactgcgcccactttcgttggccccgccccctcctcacccggacagccttttgggcagcgtcgctgctgcctgccacaacagtgcgaggtccccccatgccgcagagaccgcgcaggtgggagggacccgagactggcacagtggagacggcgaagtcctagggagagcgaagggaggtattcaggggcgcgggaggggtgatggggtatcttcaaacataggctgctctctgcctctcatttcctcagcgggcgcccaggcccttccgacccccacctgcaccccctccctccctaggctggtcccgctccgcacccggaacgtgtccgccacgatctcagctcctcggtgattggtccatttggagaggcctacgaaaaactcccggcctgagtccgggaggccgcggaggtttgagggcgggagtgagttagaaacaaggctccagacggccgagtctcccaaactctacttccctgtgccaagacctatgcctccccccagcctcaccggtgaagagaacgtcagtgccatccagcgtcgcgttctcgtctcctatttccacaattcggagccccaggtcttgcagggctttgcggactccatcgaccttaggataggagaagagggcacggagctgtgacacccccatcctcaattcttccccaaagccccgacatccagttccttctgcctttccccataccacacccgcgccacggcgctcacctctggcctacgagcggggctccagggccgcgtgattagggccgtgtccccttggatcacggccgtgtcgccaagcagcggtcccagcggcaatgactcctcaggtggcagttctagcagctgtagccccagtcgttgcctcagtttacctcccagcaccccgtgctccctttgagctttggccagatccagagcgggaaggccagcccccgcaccttcccccgacgccaggctctctgggactccccggatcagggcatgggagcagcggcccagcccctcccccggcgtccccatcccatccacacagactccccctccaaccgctcggatttcttagttttcttgtttcttcacctgtctgggagaagaaacagaaaaggaggagacagagaaaaagacatgcagacaagggcgttgggggtggttaagagcgcccaggtcttcctcctgccatctctaggcgtccctcccactccgccccacccactccagaccttccgctcctgtcgacctcactctacccagcaccctcaggggtcagattctttaagaggagcctgaggaacaaggctagggtctctaatctccaaaacacctgttgcccctgcttgggggcttgtgaggtccctgtcgggcgcccctcttggcagccactaggatgcgctcactccccaaaaatgcagcagccccgcccccttaaccctcagctgctcgctaccgcagggactggaagtccagcccgcgacccgcaggggttatgggacagaaggagaaagctggagaggcaggggctggggaatggaagtcctgaatacccgaacgagaagggagagaggtgggtaggaagggaggagttcgagcctaaggagttaagcatcctctctccgccctggctggtcacgctgcccctagcgcgacctagtataaaccagaccgagtcccgaaggactgggagaggtctaaaacgaaatgcgaggggcggggtaacagggggcgtggttccggggcgctggcactactcccggctccaggacccggttccccgtctatgtcccaaagtccaccccgcctagctccgcgcccaaataccggctccccatactctctgtctggtgcaggcatgggcccggcacccccaaactccggcccccacacggttcagggccccccacgcaagactcacctccagcggccacccccactcctgtcgcgctgtgatctcggctggggccccaccccccgaggacagagttggtggagaagggagtccccgtcttcaagcctcggggactgggagctctggcttttagcgcgggtccttgtgtaggcgagctcatatactacgatggggcaggggcgcgacggtctggcggctccggggcattgtctaagcgggacggggcggggcttcttcgggccacgcccattccgccctgctaagcctcgcccattacatccagactgcgccccccttgccagaaatcggcaccgcccagcgagcgctgcccaggcccacccagatctggccggccctggcgacggggctgcaaacgcttcgtagacctcagaacagcgcaacggcggaccggcggaccggcacgaaacatagcagccccaccacaaacatttcccttcttaattcctggcttctgccctgagctcaagatcactgacccacccctcattccatgtcgcccacactttaaatccccattgcgtaaaaacacttgatttttattctgtattttattactgaaatatgttgtcctactcatcccaccccacaataaaaatctgacccaggccccccatttctttccctcatcccctcttccaccacaccatcccggaacaagtgctccaggattccctgcccactggccattttggagtgtgtccattgggtagcaatgtggaaaccaccagggcctttgtggagaaaatggagggggttgagggagtcccaggaggggcttatttgagggcctttgccacttgctcataggcgagctcgatctcctcatcatctggacaggtggaagcgaattcttcccgggcgtaggcattgctcaagtaccgatgcactccccggaaggcctcggggatggtgaatccccggtacttcttacacaccacctgaggatggggagaggagagggaccaacatgttagacccagggaagccaccttggctttcccttctccccaggccgacatgataaaaccagctcaactcctcactgtcttgtactgtcgttagccttccttctcacttactgaaatcctggcttttaataaccagccatttttcctgagtttttaaaacttgagatataatttacttataaaattctcctcttgaatttccacagtgactttttccccctataccacttcaggcactgacacaggtgacttttgtctctatatttttcatcagacttttttttttttgagatggagtcttgctgtcacccaggctggagtgcaatggcgcgatcttggctcactgcaacctccgcctcccgggttcaagtgattctcctgcctcagcctcccaaatagctgtgattacaggtgcccaccaccatgtgcggctaatttttgtaattttagtagagatggggtttcaccatgttggccaggctggtctcgaactcctaacctcaggtggtccaccagccttggccgcccaaagtgttgggattataggcgtgagccaccacgcccggcccatctgacttttcatcatatattcttaactttcatgtgaatattttattgtctcagatttcaaccctttgagagcaaggcccagtcaccatacacttgtgtatctttcaatgcttagtacacagatgttcactacatagttgtgtggcagactgatgtcaggcccatgttgcacaaactaaaccatagctttgagactatgacaaaaacatgggaaccagcagttttgatcttccacaagaggaagtgaagactgaagttataaagaaagttaaagctttgactttaggaaaagcctgctctgtctaatctgggaatttggcagtgataccgagacaggaagagcattcttcaaaagtaatactgggatgtattcctctttgctagtctgtttgcacccatgacttacatcatggaatataattatctcaagcagtggtcttgttagcaatgactgctgcaaaggactggggtggggtctgccattggtagcaatttatgaaaaccaccctaagaaagaaatcgtctttagagtggttgtcaggggaagcccatgtgggagctccttaaagggccactccagtggtcatcctctcctcccgcaataaccacacacctgtactatgtgtaactttggcaacaggttgcagtcagccagggtgagctcgttgccatccaaaaacttcctctgagagacaccttcatcttcagcactggtttcatccacttcttctgggaggggggatgttaagtaattgtctaaaaccttcagggctttcaggagtcccttctccagatctgtgcaagagagggaactgattagaacttcaggaaaagattgacatagtccgaaaaggcccgttgggggtggatactaatggtgagtccaaaataataatagctaacactcatgtagttacttttctatgtgttattctaagcactttacattttattttatgttagacggagtcttgctccgttgcccaggctggagtgcagtggcatgatcccggctcactgcaacctctgcctcctagattcaaatgattctcctgcctcagcctcctgagtagctgggattacaggtgcctgccaccacaactggctaatttttgtatttttttcagtagagaccagtcatgttggccaggctggtctccaactcctaacctcaggtggtgcgctagcctcggcctcccaaagtgaacactttacattttacaaactcatttatatcgccgggtgcagtggctcactcctgtaatcccagcactttgggaggccgaggcaggtggatcacctgaggtcgggagttcaagaccagcctggccaacatggtgaaaccctgtctctactaaaaatacaaaaattagctgggcgtggtgatgcacgtctgtaatcccagctactcaggaggctgaggcaggagaattgcttgaacccggcaggcagaggttgcagtgagctgattgcaccactgcactccagcctgggcgacagaacgagactccatctcaaaaaaaaagaaaaaaaaaaatttatatcaacccatgaaataggtattgtcatcctaattttgtggatctggaaatggacttacagagaggtgaaatgattgctcaaaattatacggctagttggatttgtactcaggtagtctggatctagagtgatgactgttcttaagcatgaccctattctgccagaaaacaggccagcagccaactaacgtcctcagtggggcagaagaggctagggaacaaatgagaaaagcttaaaagtcttggccaatgaaaatgcagggaaatatagaggtaaagcaaaaatgggaagctgggggaaatttacgaacatctgcttcatctccctgatatctgaacgtccaggtgcccctaatgtctcctacccgctgggtcctctctattcctcccaggacccaggcctctgacccacaagactcactgtcattgagtgctgggtttgaattcttgatgtaggcagaaaatttggcaaatatgtccagcccagctgtgttggactcagggttcagagctgccagcttggggtacctgaaagccaatgggaaaaatgaggtaagatgtcttcctgggaggaacctcagctagctctcctgccccagccccaccaccatctctgttttccatttctgcaaactgtctgtttcccagaatctccctgctccacctctccactttctgagtgcccctatacctgggagggcacagcactgcctccagaaattcctcaatcttgttggtgtctgtgtgcacttcagtgccatacagcaggaatgggagctgcccccctgggcacagcttctgcactgtctcggtccgcctggagaaaggatcaggaatcaggactggaaatgggggtcaggaagaaccagaaagggggaatggaggacgtgggataagaaagggactccagggggagggcaaaaatgttcatgacagaaggactcgggtgggtgtgtgtttgcacacatgtgtacaccaggggtgtttcaaggaacataagcaggcctaccttttggtgtcaacggtggtaacattgaaggtgactcccttgagccacagtaccatgaacagtctctgggagaatgggcagttcccaatcttggccccatcactgccagcctgaaaagtaaccccaacccaaggttatgcctgatgcaccccacccatccctaggccagtccctgcattcccactcccagaccagctgttttctgcctagtcatgacacatacactgtcccctcactatgggctctttgcccttgggcctgggtcaaacctaaggcagatcaatgggaaactgttttgcaaaggcaggcttctggttccccagacactgaggacaggtgggaggtaggtagagggaggaggtcctggagaacttgggaggatctgaatcctagagagggaagggtgtggaacttcagtgaggccagagttgtaggctagaagcctggatttctgggttcctgaagggagtagagtctgaagacaggagaggtgggtggggtttgggagccagagttttggttctctacacctccaatccaaggtgtctttgggtggggagtctagtcaaggggccctgggcctcgcgctagagatgtggagggccctacagagaggggctgccctctaattagcaagtggtgacctcattggcccaagggacacctccccctaagctgagggtgattcatctctctgtctccggcttccttcctgtcaaggatgtgggggaagggacagtgaggatgaggcctgggcagctaaggctacccctaacctgctgccagggtctcccagcacaagtcctctgactgcaataaccatcctctcacaggacacagggccggaatctctgcggcacagcctcacccacgagtaaaaatagccccggaggcgaatgtgagagtgaggtggggaccacacctaagggggcggacccaagcaggctccgacttccctgggcccagggagagggaatggctgcccgagaaacccaagcagaagggagagggagacacaggcagagacacacaaagatgagagaaacaaaaggggggaaggggaaagaaaggcggcaggaaagtggagagtggggagacgtgcgtgccaacggagagacacaaacggagcggggagaagaggacactgttaaggaagggagggaggggcacagccaggaggtcccaagactgggaaatgaatgcagcagcggtagggaggggagcggccgctgcaatcagaggggggctgggtgacaccgagaagcctgctgcctgcagttttgctacccaaatgccataggaccatctctccttacccacacccgcagagagaggagagagttggggcaagtcttctacttctccaacccccaaatcccaaaatgccctaaccgagctcttctcctccgtctgatctctctcccacccatccttgtggtagctacgttaaactcacgtcttcttgccacctccccttctgtccctttccccagtcctggggatattcaatgccacccgatcacctctccagctctgcttttcaaactccgatcccagtctcctgttttgttccgcccctccaaagcttcccaatttacttgctctcactctcaggcctccctcaacacaccgtcttccctgaagcgtctccatccacacacacacacacacacacacacacacacacacacacacacctctcctactgcactactcaccctcagatcttgtagggacacatgtcctaactgaggttcccctctgtcccttctaaaccctgctgggcccccactgtcccttcaccagctcgccctctaaccccaccccagtctcacttttgggaattctcctttttctccacttcccttcctttagtctgctagaaacttgcacttttacaaacttttcagggttgatcctagaattctcattacttgctaacaagttaatgtcttcccctctcaaaaccacccctcaaccaaagagtgcacgtgggattgggggtgggagtcaaggagggaagggattggggagttaaggctggaccgggggaaaggtgagagttggcttccaggaatttgggtggctgaggagagaagtgttcttaccttcacgaacaattcgacctgcggttgttcttcagccatggttgcgtcggggaccaggaagtggccgtccctgggggaactgggaggggctgggaccggggaaggcgggtctcacactcagggactctctcccctagacccagggctgtcccttcagcacaacacaagctcaatcagacctacttgcacccaaactaggcctccccaccagcccaacgcaccccacacccagctcctccagctcggtcctctcccgggctggatcagagagccgctgactcaccgaccggccccgccctgaacctggggaggggactggaggggggcgggactcgacgatgtagggagtgagtccggaaggggaatcctcggatctcccacaggatggggatgggggtgttaaggaggagtcctgaaaacctccttgtttctccgacctctcctgaacacaggactcttttctgcctcagtttccctgcttcattaatctgagtacaacccgactgaccctcatataaaaaacttgacactaacagcttgggcacacccgtgaagattcagggatggggacttcaaatggaaaggtggtcgtttaatcattctgcatttcttccagactccaatccaaattctgggttgctgggactgtggtctgagagaagaactcggaagtggaaggctgggactgcagataggaaccgttagccatgcagcctgggattagggaaggggtgacgccagcactccctgagctgcccagactggtgtctcagtaggtcctgtgccccccgcagtctactgtctccgggcccagctcagcactaggacttgcagtccttgtggcctacacttgggattgggcataggaaatagagttaggggccgggtgaggtggctcacgcctgtaatcccaacactttaggaggccaaggggggtggatcacctgaggtcagggagtcaagaccagactggccaacatggtgaaaccctgtctctactaaaaatacaaaaatttgccaggcggggtggtgggcacctgtaatcccagctacttgggaggctgaggcaggagaatcaattgaacccgggaggtgaaggttgcagtgagctgagatggtgccattgcactccagcctgggcaataagagcgaaactccatctcaaaaaaaaaaaaaaaaaaagaagaagaagaaaagaaaaagaaagtagagttagggatgggaagggagatgacgaagtcttttgcgaaggaaacataaagccgaggcaaggggctttgttgcagggaggggtctgttcctgtagcttggtcagctttgtgcttccacttatgtttcctattggggccccttcctgtgccctttgtcctcgtctcactgacaggttgccttggagatggggcagaggggtgggattatcatggcccgatcctgaagtatgtgtatagggggtggggtaggggtgttgttagctggtcctgtcatggggataaagaaagatcagacagaatagtgggagtagagtccttggggacacctaaataaataagcagggaggacataggaggagcagctctctctccagtaaccttgatttctattaaacctttatgacctgctgaaaaaataaacccagaattccagcctccatatcctgaatttctctcctgtccaaccatcccttctctatcctcctcatcaccctctgtccaacaaaagacctacagttccagaaaaccatggtggagtgcaagaacacagaactaaaacagagcttgaaacttaaagaaagggagagacttgggggaggagtggggtggagtgacgtgatgtgctgctggaaaccagcagttggtggtttcctcttgtgcttcctcttctgtgggttttctcctgcttgtgggagggcctttttctctcctcccgacagaaaggctatctttggtgttcgttcccttgaactgtaacatcctgtaagggtatgattccatgcctctgtgtgggtgtgaattccctcatggtgaccctcaaaatctgcacacaggaccccttcccattgaggggaggggatcaaaacaactctacttctcagggtcctctcctgttccaactggtctgtgtccaagagaagccttaggtaaatggggccagcttgaagatcaaacaggtttggcagcctctcccggcctctcttttctctcctacagctttatagctacagctgccttgatatcaatattgactttggctggctggcatgactacccacagggtatcgtgccttaatttaccaggtgacaggcaacgctgccctctcctggaaccatccagcagagccagggctgtacccccaaatcctgcaacagaggtttccctccatctcacctccctgtccctgcatttctcctatctcagtagctcctctttccctctctgggcttctctttccactccctccccttcctgggcttggtaaactagtccctaatctcttcacaccccagattggaaggtgggtccctccctgacactccccagagctgtcaccaacctcctccaagtttctatagctccattgctcaacagatttgccaggggtaaccattaacccagcccttaactctgttcccccacctttcttgctggaggggattttccaattactggttagcacagctaggtcatctcacccccaccatctttcctaacttcttgggttggggggctggggaggaatctccccatctcagggtactaggaacaaagctggggaggatggtgcatttaaagggattatatatatatatatatatattttttttctttctccctcataaccccacccccgcaacacacacacacacacacacacacacacacacacacacagacgcacaaataagctttatggagcagtgacttcattatgttcaccgctttgagtccaacccctggcccaaaataggcactaaatagttgccgaatgcatgaatgatagatacctctctgtcttcaggggtgtgtagaagtgcgaaggggtatgggcatgtcccagtaggggtgtgagtgttctgatcagaactacttctctctgccagaatttgatgtaattcgaatgcttccacctctgcttgaagggtttaaataataaattaggccctgtcgtgccattatgggggtggtcataccctgtacccaggaaacaggcacggtagggctgagacagaagtcctgcttgtttccgcttatttatttgaaacaccgctcatttaggtcttactttgtttgccaggcactgttctaagctctgtataaatattaactcagagggtacaaatattaacttaagagttgttgcaggaaaaaaaataagcgcctctggctctttaagtttggcctccccctcaaaacccccgcaacggtcccaaaccccttccagggactgggactacggaccctggtccgaccttctcgcgggcttcccactgcgccaatcaaatcccagaaacagtgagtgctagaggcccggctgctaagcaacggcagagggcgggaagtttgaacgttctggacccgccccgaaggcaaataggccaatcagcgtccagactcttcagctacggcagtccgcttctcctcctcgccctgtcggatctctaggctggatccgggcctctccaatcaacagcggttaggagggcggggcgcgtgcgcgcgcacctcgctcacgcgccggcgcgctccttttgcaggctcgtggcggtcggtcagcggggcgttctcccacctgtagcgactcaggttactgaaaaggcgggaaaacgctgcgatggcggcagctgggggaggaggaagataagcgcgtgaggctggggtcctggcgcgtggttggcagaggcagagacataagacgtgcacgactcgccccacagggccctcagaccccttccttccaaagggtaacctccgcgtgacaggaatgagggtggggcgcgtggagtttcccacaatctgtactttagttaaatacccgagaattcacctcctgtgtccacagctctccacgcccctcagccctgccccgcagccctgtagcagaagtacttagtgctttgcattctgcgcgccaccctaccccggcctcctctgtgaatcgttgcttccgaaccgccctcactttttgcatccgcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgaggtctctgaggggagtagaaacttgaatggagagttgatgggaagttagaataaaagagggttgggagccgggcgcggtggctcacacctgtaatcttagcactttgggagactgaggcgggcggatcacctgagctcaggagttggagaccagcctgggcaacatggcgaaaccccgtctctactaaaaatataaaaattagccgagcgtggtggcacgtgcctgttatcccagctactgggaaggctgaggcaggagaatcactgtaactcgggaggcggaggttgcaatgagctgagattgctccactgcacttcagcctgggcgacagagcaagactccgtctcaaagaaagaaagaaaaaaaaaacagggttgggaagagctgggcaagtctcttacctcctgagtggctgtttcacattcactaaatgggggtgatgatgcctatctcagagatttgagaaaatgattaaattatataagacatggtaaaccctacacttatgagtgattctaatagtgatttcctttcttccttgctggacagatccatctgtgtgtgctgtggaattcaggatacttgggcattgcctactatgatactagtgactccactatccacttcatgccagatgccccagaccacgagagcctcaagcttctccagagaggtggggatggaaccatgaattcctctgctctctgggattgcagatgtgttacacacacacacacacacacacacacacacacacacacacacacacatattttttttttctagacagagtcttgctctgttacccaggctcaagtgcagtggcgcaatcttggctcactgcagcctccacctcctgggttcaagcaattctcctgactcaacctcccgagtagctgggactacaggcgtgtgccaccacacccagctagttttttgtgtgtgtttttagcacagacggtgtttcaccatgttggccagggtggtctcaaactcctgaccttgtgatccgcccaccttggcctcctaaagtgctgggactacaggtgtgagtcaccacgcccagccatgttttacttacattaactcacctcactgtctagcatattttgtgttgctgtaaggaaatacctgactctgagtaatttgttaaaaaaaaaaaaaaagttttatttggcttatggttctggatggttggaaagctcaaaattgggcatcttcactggtgagagcctcagactgcttcaactcatggaagaagggaaggcagggtgtgtagaggtcacatggcagagaagaagcaagggggagggagatgccaggctctttttgacaaccagctctctcaggaactaatagagtgagaacctctcactcatacccaccaacacactccaggaagggcattaatctgttcatgagcgatccactcccatcacccacacacctcctgctaggccctacctcacaacactatcacactggggattaaatttcaacacgatatttggcagggacaaatcacatccaaactatagcactgactcaatatattttacagttgcttcacagaggctccctcttttgtttttatgaattcatttcattatttaacaaatatttgtgaggctgttttttggtttgtttggttgttcttttttgagacagtgtcttgctccgtcactcaggctggaagtgtagtggtgccatcttggctcactgcaacctccgtctcccggattcaagcaattctcctgcctcagtctcccgagtagctgggattacaagaatctgccatcacgcctggctaatttttatatttttagtagaggcagggtttcaccacgttggctaggcttgtcttgagctcctggcctccagtgatctgcctgccttggcctcccaaagggcagggattataggcatgagccactgtgcctggccacaaatatatatgacgtatttacaatgtttcaggtgcttcagattcagccctgggcaaatcagtcatgtctgttctccaggggtttacagcctagtgacaacatccagaacatcccacttccctctcaccatcccaccactcttaactacttttctaaatctcaacttctacctgtgttcccactgtgcagagcactccctactcctagggaggaaatgtttttgagaaggagaggggtaggaagaggagggctatgggttttctcttagtcaaagacaaagatcctttaactcatttgatctctgttctccttccaagttctggatgagatcaatccccagtctgttgttacgagtgccaaacaggatgagaatatgactcgatttctgggaaagcttggtaaggacttggtaaaggatagagggaaaatggggaaggactaatatatggaatattccagggggctagaattgggtgagagggagtgtcagacagaggtagaaggactgagatgtaaagaatgatagccttttctttcctcccccacagcctcccaggagcacagagagcctaaaagacctgaaatcatatttttgccaagtgtggattttggtatctccttccttttgctttgcctaactccctgttccggtgtcccattctttcccccaactctaccttcatcatcacagatctcccctctgccttatgtcatcctaaacctttgtgctcctcatgccctatgacctgtccccccaagatctctcctgctccctaccctttaataacctgcagcttattgggaagcctctgcttaagtcatgtctagggatgagggcctcccctgaggagtggtgacactttttggacagggttttattgttggaattctccccattaagttaaagccttttatcaccaaaccaaaaggcactgcctcagtgacccttattatgatccataaggcacttctataactttcctaggtttacaataagaacaggagtgtactatcctaattagatattaaggcattagtgttactagttctattaataccattattttgaccaaaatcctcaattccagacagatgtctactttcctcagccatttatctttctcaggctgtgctttcagacaagtatctttatattatatgtagaataaaaagagaattagactaagagtctgaaaatttggttcttgctctagctttccattaactgcctgtgtgagcttgggcaagtcaaataatctctcttgcttctattgtctcattcttaaaatggggtgaaaaaattgagctacaagaccgttccctttgcttgcctccctcaaataggtctggagataagcaaacaacgcctcctttctggaaactactccttcatcccagacgccatgactgccactgagaaaatcctcttcctctcttccattattccctttgactgcctcctcacagtgagattggtcctgggggataagggctgggaggcggcacaagtgctagggctgaattctgggaggtactggcctagccctggaaaatagtaactttccctggtgctctgcagcccccaggagatttaagatttaccccgattccactgctgatcccctcccaggttcgagcacttggagggctgctgaagttcctgggtcgaagaagaatcggggttgaactggaagactataatgtcagcgtccccatcctgggctttaagaaatttatgttgtaggtgattcaccccaaccccaaccaaagtaatgtgggattgggaggcctgaaaagtaaagtgggggtggggtgtggatgtggctgtgacccagtgggtcaagtgctctaggacacccgggagaatctaagggctaatgagactttgggaagaagactgggacaatattcagagagggggacaaaggaagtggagttgtggaacgaactcagactgcttcctgcttttttgttttctgtcctcaggactcatctggtgaacatagatcaagacacttacaggtaaagaggtggaggcatgctgctgtctctggggagggagaaggattaagtttaatgccccaataatcctaatgaggctctagtttccctaatcctggggctattaagatctctctccttgaaggaaagggaaggggggttttgagggaaagagaggaagaaaagcataaagatactagctttcttttctatagggagaaactgaggcaaagaaaagtaagggacaaaccttacatcaagatatgatctcggctgggcgcggtggctcatgcctgtaatccccgcgctttgggaggccaaggcgggtggatcgcctgaggtcaggagtttgagacctgaccaatatggtaaaaccccgtctctactaaaaatataaaaattagctgggtgtgttgtgcgcctgtaatcccagccactcaggaggctgaggcaggattgcttgaatccaggaggcagaggttgcagtgagctgaaattgcaccactgcactccagcctgggcgacagagcgagactccatctcaaaaaaaaaaaaaaaaaaaaaaagacgtgatctcaggaggatatcccctgtccccattccatttatcagtcctcaattcttattcccttcaaaagtccaagttaccccaaactcctccatttctcctcgacagtgttctacagatttttaagagtgagtctcacccctcagtgtacaaagtggccagtggactgaaggaggggctcagcctctttggtaggtgtgccccatccctcatctcacattacaaagacctaccagaaaagcaattggctccaaagatgtgtcccagcctcccttcccacttcactcccattgtcagatatctctttcatgccaatccaaatttcttacctatttgtaccccccgccccccaagcttgagcatcttcccatactttgtggctgtacagtgttgttgcatatcagccattactttaccaattctgtgttccttccctgggtttgtatgaatgtttctactagttgggtacctgttagggactttgggagaccttgtgtatagagaagagttttgtaactgcataactgcctatttgatttgtatagagtctttatcagttgtctctggctttagggtatattagggacatctccgcaaatatccatatagtttcatatctcagtaagttgtgtccaggttttttttttttttttttttgatacagagtctcgctctgtcgcccaggctggagtgcagtggtgcaatatcagctcactgcaagctctgcctcctgggttcacaccattctgctgcctcagcctcctgagtagctaggactacaggtgcccaccacgatgcctggctaatttttgtatttttagtagagaacgggtttcactgtgttagccaggatgatctcgatctcctgacctcgtgatccgtccacctcggcctcccaaagtgctgggattacaggcgtgagccaccgcgcctggccagttgtgtccagttttgtgtgtgtgtgtgtgtgtgtgtgtgtgtgtgtgagacgaagtctcgctcttgtcccccaggctggagtgcaatggtgcgatctcggctcaatgcaacctctgcctcctgggttcaagcgattctcctgcctcagcctcctgagtaactgggattacaggcacctgccaccacgcccagctaatttttgtatttttagtagagacggggtttcaccatgttgcccaggctggtc

SEQ ID NO: 511 - DNA, 96859 bp, Homo sapiens
tagggaaaatagaaagaacgtatgctgaaatattgggggctggttcccccgatagtgggtcctttgggaagtaattaggctataagaatggaagggattacagcccttataaaaagaactcagagagctagcttgtcctcttcccatcatgtgaggatgcaatgagaagttagcagtctgcaacccagaagccctcaccaaagccctaccatcagagtgccctaacctggcactctgatctcctacttctagcctcttgaactctgaaaaataaatttctgttgtttatgagccacccaatctatagtactttgttaaagcagcccaaactgaccaagacaaatggaggcagttactacatagtattcacaattgacatgtaatctgcaacacctatatcacgttgccataggatttctcaataataaaaacagctttcagttaatgcatatagaataagatcaagttggatgtcagagaaggaaggaggagaggttaatctattgccttgttttgaacaacaacaacaaaaaaaagcaggggagggatgtaataatatattgtaggaaaacactttataaaatgagtagcttatctagcatttagacattggctatttcattaaatctctaggaactgaattgaagtttaataaactaatgagaggacctttgattttccttgcaccagaaaacagagaatgatgcctgtgaaatgaaaggtttatcatatgtgagatagcttcatcctgcaaggaaattgatattatgcttgttactttctacatgtattcaaggactagtatcaccatccacatttcacaggtgatcactgaatatttttcaggaatttcttacattgctaatgattagaagttgcttttctcatcattccagtgtataatcaggccagcatatttcagagagaagcgcaatcacaaatccaggttctgattaatagaaagctaacaggtaagaaatatttagcagaaattcaaaaatcaagggaatagtagaaaactaaaactgagacaaatactgtcattgtttgtttttaagatgccactgcatataaatacatgtatctcttgattttcacactccatttggaaacctgcacccccttctctctccccagggcaatgcagagaggtgcagtggactcagctaggctgggagagtcagacacagcatggcctgagaggcccctcagccactggagccctatctttgccccaacctgcctgtctctgtgccaggctggataaggcacaggagaacttaattgagaataagcttcactctgtgctggggctggtgggggtgttgaaggaagaggaaaagcttgaatctttaaaaatagttggccatttgcaattacaattcttttcactcttaaatattcaatagggaaaaggacaggcatgacctttgaaaggggctggtagttttctggaagctgctatggctggttaatagaaatgagatacggtccaagttgcaaagatgctaaaatattttataaagaaaaggagatataacttgaaaactgtcactttctttagactttaggggactgctgcttttcacccttcccatataacagaatgcaatgcagagaacacaacttcttcttcccatagtccttttcatctgggtccttcttctggcttccctggtgatcagcactgaatgtcagagctgcgactctagcagttgtcctttgtcagcaaagctttaccccatcgggggagtaactcagacctttaatttcctcaaacatcactcacggctcaagtatttaagaaaacctcattgaagactcaatggtaacaaccaaacaacaacaacaacaaaacaggagagctcattacatgagaaacttaaaacttgatataaactctgatatttccctgattttaccccaacacctgttcttagagggtgatattatgtagatctcttttctcaatctgaagttgctggtgtggtctatgtcctactcatccttactaaaaagcagaaaaaagaaagaagaagaaaggaaggaagggaagggaagggaagggaaggaaagagaagggaagggaagggaggcatgcaggcaggcaggcctcttttttaacagcttttagtccacagccccaaatacctttatctgaacccaggccaaaatattaaaagtacccttattataatctgttcagacaactcagttttagttgttgtcatggtattcgtgttgttttgctggactcatgacttaaaaaatcttgatctaaagctcagtcttttcattacttttctagtaaagagttttcccaagaaaacatcttatcagtgcagttccttccaatttaaacaagaggcctcctcaaggctaattttcatttcattgtattttattgtgttaagaacacaacatgagatctactcccttcttaagaaattgttaagtgtatagtacattattgttggtacaatgttgcacagtagatctctagagcttattattttgcctgacttaaactttatgcctgttgattagcaaccccattctctctaccctcaggccctggcaaccgccctttcattgagttcataaatttgactattttggacacatcatatatgtggaatcatacaatgtttgtctttctgtgactagtttatttcacttagcatactattttcaaggttcatctgcattgttgcaaatcacagaactcaaagtggatttaagacttacatgtaaggtcccaaactgtaaaagttctagaggaaacacaggggaaaaaaacttcacggcaatgttcttggggatgattttatgcatatgacaccaaaagcataggcaacaaaaacaaaaacagacaagtgaaatgacatcaaactaaaaatcttctatacagcaagataaacaatcaatagagtgaaagggcaactaatagaatgggaaaaatatttgcaaaccatatgtctgataagaggttataatccaaagtacataaggaaattctacaactcaatagtaaaataaataaataaataaataaataaataaataaacaaacaaacacctctttaaaatgggctaaggagaatggacatttctcaacagaaaacataaaaatggccaacaagtgtgtgaaaagttgctcaacatcactaatcattagggaaatgtaaatcaaaaccataatgagatatcacctcatacatgctacaatggccattataaataaaaccaaagcaaaacaagacaaaaaaatgagtaaataatatgtgtacacaaggatatggagaaattgggacccttatacactgttggtgagaatgcaaaatggtacagccactagggaaaacagcatggagattcctcaaaaaattaaaaatagaactaccatatgatccagcaattctacttctggttcaattcactagaattgaaatcaggtttttgaagagatattagcactcttatgttcattgcagcattattcataatagccaagatgtgaaaataaccaaaatattaaaacttaaactgtcacattaatcattttaaaagtttatttgagcaaacagcaatttatgaattggacagcactcaattgtggtgctagttggtcggggaggaaaggtttcaaagacagggttttataaggtgagtgggaaagcaaagcaaagaaaataattgtttacagttatgtagttgccttatttggattacccagtggaaatttctagttatgcagtttgaagttagtggtttctgattgattaagtttaaattttatctctctctaagttagttacaaggaaggcattcaagttagatttaggttgcttatattggatctcagggcactgaagctgcctcaggtgaattgcctcctatttagttattttagcaatgtttattgacagataaatgaataaacaaagtgtgatatgtccacacagtggaatattattcagccttttaaataaacaagggcaaatttttatttcttcattgaaatgttaaaattatgatgccaaaatgaaaacctctgtagttttgataatgttaatattaaaaaacacctccaaaaatcaatggaagatcttttgtgtaaggaggtgttaagcctttatgacgaaaaagggaaaagagctgcactcaaatgtttagtggccagattagcaaatgactaatacttaacttttttgtatgtaaaatttgtagctaaacttcttggtaaattgaggttttaaaatcagggagaaggacttctgcttctggaaagatggagtagacatcttttttttcctatttcttctactaagttcaactaaaaactctggacattacatataaaacaaacataagaagacattgaaggtagaaaaagaagacagactagctagcaaactctggattcaaggaacaacattctggtaagttacttgggttttttctttgcctcatatatctcagttgaagaagctggcaatcggcaaacaccaacagatacagaaaataagagacccataaaaggccattttttctagccaaagtaccaggaaaggaacaacctagcaagacaaaaatcttttatacggtaaatgctttattctagccatctaccacagaaaagaactgtggctccacacttaccagtaagggtggggaaagtagacttccacattttctaggcacctaattcctcccttgtggtgtcagagaaggccaattagaaagccaggactttcatccttattgggtagataataagccatctccctccccttgatgtcagtggtgactacttgtggatgtagaatttctatccatcataaggtgacctccacccactcctgactggagtgatatcagaggaagttaaatagagaatcaggattgccatcaacgccagtgctaataagacccctccattctggtgtaagcagaggctctgtgggaagcagttaaaaggcactcctatcccttccagacaaggcgatgttcagtggaggcctactggagagctacaactccatccttttcctgcagcaatgaggaatcttcctaccctcaggtgtcaatgcatgtaattgtggaacctgtgcttctatcctcacctggcagtaggtggtgctcacatctttccatgctagaatggtgtcaaaataagacagctaaacagaaagattaaataagaacaagagttccataaaacacccaaaatatccaggtttcaattgaaaaacactcattatggcaaggatcagaaagatctcaaaaatgaaaaaaaggcaatcaacagatgccaaaacagagatgacaacaatgttagaaatatctgacaagattttaaaagtcatcataaaaatttttcatgagcaatttataaacatattagagaaaaaatcagaatgtctcagaaaaaagaaaaatctcaacagtaatatagaagatataaataagaaccaaatggaaattttagaactaaaaaataccataattataaaaaaactcaatgaatgggctcaaaaaattgaatagaatggaaagaagagtcagtggacttcaagatagaaaaaagaaattacttaatctgtaaaacaaatcagacagaaaaaaatagagctttaggaacctgtatgtggaggctaaagcaacttcatcttggaggctaatccaccatgttgacatctgattaacccctattctaggaaggcctctaagatttccagtatgtcttttgtttcttggcaaagagcacttacttactgtaaatcctgctcttaggtcaaaacaaccttgatgttattgtacttcaattgtcctacacatcccttcggaatgtaggaggttccaacacctggtctcgccacagcccaaaacacagacatggcttctatctgtaggcccttattaaacatgtatttctgagaaactggatatgccagcctctttctttggcctctcaacttccttggactttgaggataggcttgtataggataggcccaccatggaacactgtgaaactataataaagttctgactctcatgccatctacatctggaagaaagataaaaaagggagagaataaaaaggtactcaaagaaataatgactgaaaacttcccaaatttggcataaggcacaatcctatagattcaagaagctgagtgaactcccaaaagaaaaaaacaaaggacatgccaagaaacatgtggtcaaacttctgaaaactaaagataaagaaaaattattaaaaacagcaagcactgaaaaaaaagaacagtcaatttagaatcttatttctagcataaatagtctcataatgaaaaagctgtctaaagagacatccttaaaaatattacagataaatcaaaattgaattataaaaaatgtttaagatagctccaggaaaaagtaagcagagaaataaaaagcaaagatgataaacaaaacaccaaaaataaaatggctggcttgagccctaaaatatcaataattacattaaaactaaatggattaaatactccaattagacttttataacttacatactttgcagataacatgattgtctacagagactttcaagggctgtacacaataaaacccctagaactagtaagtgctttcagtgaggtttcataaacataaaaagctacattatcaggttggtgcaaacataattgcagttgttgcattgttgaaatttgctgtttgatattggaatacattcttaaataaatgtggttatgttgtacatcattttaacgcacatttctcgctttttttgcgaatgacttattacttgctctttattttatatttattttagactctggaaatgatattagataaaaagcaaatttgagcgattttcttattgagttcaaaatggatcataaagcagcagagacaaattgcaacatcaacaatgcatttagcccagaaattgctgacaaaggtacagtgcagtggtggttcaagaagttttgcaaaggagacaagagccttgaagatgaggagcatagtgaccggccatgtgaagctgatgaccaattgagagcaatcattgaagctgatcctcctacaactacacgagaagttgctgaataactcaatgtcgaccattctatggttgtttggcatttgaagcaaattggaaaagtgaaaaagcgataagtgggtgcttcatgagctgagtgaaaattttaaaaaactgtcattttgaagtgttgtcatctcttattctatgcaacaacaatgaaccatttctcaatcggattgtgatgtgtgatgaaaagtggattttgtatgacaaccagctccgtggttggacggagaaaaagctccaaagctcttcccaaagccaaacttacaccaaaaaaaaagtctttgtcactgtttggtggtctactgccggtatgatccaaaatagctttctgaatcttggcgaaatcattacatctaagaagtatgctcagccaatcgatgagataaattgaaaactgcaatgcctgcagcaggcattggtcaacagaaatggcccaattcttctccgtgacagcggctgaccccatgtcacacaaacaatgcttcaaaagtcaaatgaattgggctacaaagttttgcctcatctgttatattcacgtgacccctcgccaactgactaccacttcttcaaggatctcaacaactttttgcagggaaaacacttccacaaccagtagggtgcagaaaatgctttccaagattgcatcaaattctgaagcacagatttttacactacaagaataagcaaacatttcttattggcaaaaatgcgttgattgtaatggttcctattttgattgataaagatatgtttgagactagttataatgatttaaaattcacagtccaaaatggaaattactcttacaacaacctaatatatttctaaatagtagcaaagaatgcaaggtagtaatattaaaaatacaataccactaaaatcaggaaaaaaagagacacttaggtataaatctaacaagacatgtagaggactgtatgaggtatcaagagtattctagaaactacaaagtgctgagaaatcaaatagataagaagcctcaacatgatagaactgttcattctgcccaaattgatatagagatttaatgtaacttttattgaattacacaagattttttctctatacagacaagattattctaaaatgtgtatgaaaaaaacaaagaaagtaaaatagctaaaatgatttatttaattaataataaggtagaattttaatgagtctaaatgatttcaagactaactgtataggtattcaagactgcatagtattggtagaagagtagctcaatggaacagaataaaaattgcagaagtcgaaccataaaatatgcccaactattttttattattagacttatttcaaaaaaagaaattctaggtttataaaaaattgagtggaaagtacagaaaattcctatatagcctctcatcctacccagtttcccttataacatattgtttagtgtggtatatacgttacaattcatcagagatattggtctgtatattcttttctttttttcttttctttttttttttttttttgagatggaatcttgttcttttgtccaggctgagtgcagtggtgcaatctcggctcattgcaacctctgcctccagggttcaagcaattctcctgcctcagcctcccgagcagctgggattacaggcgcacatcaccatgcccggctaaaatttgtatttttttagtggagacggggtttcaccaagttgtccaggctggtcttgaactcctgaccttgtgatctgcccgcctcagcctcccaaagtgctgggattacaggcgtgagccaccatgccctgccggtctgtgtatttttttcatgttgtacacttaattagctttgctttcagggtgatgctggctttgtagaatgtgttagggagtattccctcatccttgattttttagaacagtttcagtaagattagtttcagttctcccatgcctgtttgaaataaactggctgggatccagctgtctggtcctgggctttcccccaccacccccaggcagatgtttaataactgattcaatttcactgttcattattgacctgttcaggatttctatttcttcctggttcaatcttaagaggctgtatgttttcagtaatttacccatttcttctagattttctactttgtgtgcatagagatgctcatagtagcctctgatgagcttttctgtttctctcctgttagttgcaatgacatctttatcattttttattgtgcctattttaatcttctctattttcttttttaatctagctagtattctatcaattttatcattttcaaagaagcaactttctgtttcattgatcatttgtattgtgttttttaaacctcaatttatatagttctgttaatttttgttatttattatcttctgctagctttaggtatggtttgttcttgtttttctagttgttttaggtgcagtgttaggttgtttacatgagatcttcttatctatttgatgcagacatcaacattataaactttactcttagcactgcttttgctgtatcccagaggttttggtatgttctgattctattttcattctttccaaaaattttttgatttttgcctgaatttcattttgacctaacaattattcaaaagcagattatttagtatttgtgtagttttaagggatcctctgggtgtcaatttatagtcttattcccctgtggttcgaataaggtacttaatattatttcaagttttaaaaatttattaagactttccttgtggcctagcacatggtcaatttttgagactatcccttgtgcaggcaagaagaatgtatatcctattgttctagggtagaaaattctgtaaatgtctgttaagtctagcatccaatttaaccagaatttcttttttgatcttctgcatcaatgacctgtctagtgctgtcagtggggtattgacattcactataattttattgggatctgtatttttttcttaggccttagacaaatactttgtagtatttgtcgtatcagtctgggtgctctcgtgttgaattcatctccttatcttatataatgatgttctttgtctttttaaactgttgttgatttgaagtgttttatctgatatatgcatagctattcctgctcacttttggtttttgtctgcatgaagtctctttttactcacctttatttggagtctgtaaatgtctttaccatttaggtaggtttcttctatgcagcatgtagttggatcttgttttgttatccattctgccagcctatattttttaagtggagcatttagtccatttatatttatggttagttttggtacatgaagttttgtccctgccataatgttagttattacttggttgctttgcagtctcagttgtgtaattgtttcatataacctgtgagttttacattttcatgtgtttttgtgatgatgagaatcatcctttcatttccacgtttagaacttctttgagcatttcttacaggacgagtctagtgttgatgaattcttagtgtttgcttaccttaaaaagactttatttctctttaattagtgaagattagtttagcagaatacaacattcttggctggcatttgttttctttaagaagactgaaaacaggaccccggtctcttctggcatataatgtttcagctgagaagtccactgttagtatgatgagatttccttcataggtgattagatgcttctctcttgccactgttagcactttttggttcatgtttactttggatactctgatgactatattccttggtgagattcttgcaatgtatccttcaggagttctctgagtttattgtatctgaatgtctagatctctagcaagaccagggaagttttcctgaattattgccttacctggtttttcatactttttactttttcttcttctcccttaagaatacctgcaaatcatatgtttggatgctttacatagtcccgtatttctcaaagtctttgtaaattctttttgctttatttttatctgactgtgttattctaaaagacctgtctaccacctataaaataatttttctgcttggacaagtctattgttgaagatttcaactctattttgtaaatccttcagtgaatttttaatttccaaaagttctgtttttgtttttttttaaaataatgtctgtctctttttatatcccgaattgtttttctgaattctttgtgttgcttttcaactttctcttagatatcatgggccttctttaaaagacaatattttgagttctttatctgatatttcaaaaagtacattttggttaatacacattgctagagagttaatgtggtcctttgggggtgttgaaatattctgggtttttttatactttcagaattgtttctctgatttcttctcatctggataagctatctctccatatttttaaattttctgcattttgatgggatttttcttcccttgaggatgtgactataatgtgtgttgtgcagaatatttggctttggttctgggttctttcagtggcaaagactctgtataagttccttgattatagatggcctttgtatggtgactttctcagatgctgggtgtagtaacaatgtactgggtatgaaagcaggctcactgtgtcctgtgaggccggcatgcagcggtatcaggaagcttatctcatttaccagtgttgtgcacttgggtcagcagattttcttttaggttgtgcagatcattctccaaggattgaaaagacaatcctttctccatcgaacttccttttaccatttgttaaagatcagttgactatatttgtatgagtctatttctgtgctctctactctgttccactgatctatgtgttcattctttatcaatatcacactgtaattttactgtaatcagtagtaacacaaattattttgacaaaggtgcaaaagtaattcaacaaattagcaagtggtgctggggcaattggacttacatgggcaaaaatatattcattcatctaagtttcataccttgtacagatattaagttgataaaagatttaaatgtaaaaataaaacttttttaaaaatatggggggattgggatctagtctgtggcaaagagtttttagacatcaaaagtaagatatgtaaaatgaaaaggtgataaattaaacttatcaaaattagaaaactttgctctgtgaaaaatttttttaaagagataaaaatataagccataagctcagtgaaaatatctggaaattacatatctgacaaaggattagtatctagatactatatacctatgtatacacatatcataattcaactgtgaaaaatcaaataattaagttaaaaatgggcaaaaatcatgagacatttcaccaaagaaaaacagatgggaacttagctcatgaaaagttgcttaagttcattagccaccagtaaaatgcaaattcagaccaatgatatctcattaaaaacaatgagatatcactaaacacttaacagaatgacttaaatagcaagcggtgacaataccaagtgcttgtgacaacatggagaacctggatcactcacacattgtagaatgtaaaatgaaacagtaatgctgaggaactatttggtgcaagaggcttagcttttactctatctgggctctcaacatgccttcctcactaagcttaatcatttctagctaacttaaaatgagagaaatgatactttttctttcacttgaacatagtggtcattgcagtgttatttgttggcttagtttcaatattgttgtgtctcagggaatagggaagtccaaggagagggagagagatgagggaattggctgattgatggggaggtcaggacacacacatttattgattaagtttgctctcttatatggatgcggtttatggcacctaaaacaattacaatagtaacgtcaaaaatcactgattatagatcaccataacagatataataagaatgaaaaagtttgaaatattgcaagaattactaaaatatgacagaggcaagaagtgagcacttgctgttagaaaattggtgcttatagaattgcttgatgcagggttgccataaaccttcaatttgtaaaaaaaaaaagaaatgcagtatctgcaaagcgaagtaaagcacaatacataagatctatctgtataaaaaataaacagtttaatttaaaaaatcttggggcaatattccatattaagatgtgcaaaggaaaattaaacagtctcaggatcccccaaacttcttatgcaaaaggaaaaaaggctgagtcttgcagtactcttttccaaacgaatatctgttactaatactatgtctcagccagatccctatggataggtaaaaggcctccagcatctgctgaaggactgcctccacaggtctttcagaaataaatcttttgctggctttccataaacaatcacatgccaattataacctttaggagctatctaattttagctcctaaaactccacactgatactgtcattacaagctcattttctcaggtggagaataaaggccagattcatttcccccacctacccagagatatctgcataattggtttttcctttactccgcttttcttttcaaacattcaccttgtcttatgtaaaatgtagttttactgggcactaactaaagtctcacagaaatgtaactatttgcctaacctccttccctacataccttccgcctccaactctaagggaagatataaatactaaatttcctgaaaacctctttggagaaacagccatacatgtgtctgtggcttgtctttttcctggatgcaccataagcaggcttaataaacctcagtgattaagagttatgcctcagtcactcattttagttgtcagatgccctcataggtcaaggttcctacaaaaaaaagtcaaaccagagagacagctggctttctttcccaagctcaatacttgaacacttaaagtggagaaacaaaacaacaacaacaaagaaatgtagaaaataatttaaaaattcttggcatgagaggcattattttgaacccttgtgcagggatgcagcttttccctgaagaaggaaatagccaggtgaggctgtgggaagacaacaaataaaggaactgtttaaagttctgcttttgcttctcccctgacattgcctcaggacaaacagttcctgatctttgcactggctgctactcaaagctctagtccagttaccgtcagaagtaaattcatgcctgataagaagtcttatagctatgaagatgagatttaaaaaaaaaatactttcaagcagttatttccaatacctccctattcaaattctccaagggctagtaaattataatttaaagaggttctcctaataaacttctcccatatttgcgggaattaggagtgtttttattgttctgtttatcttttggtctctggggctctctccccaagagctcatccagctccttcatcccaggaggtgactggagctcactagactggagactgcttttcttctgcatgtactgcctgacagtgtagccagtattctcatgggatataagctcacaaactaaaataataagtctttgaagagttcaaatatttcaaaagaaattaaacatgctttattaaagattctaatagagcacaagtactagaacaaaaggaccaagaatataaaattatccaaattaacatatgaaaagagacaagggaaaatattaggaataattaaggtatgaaagtttttaaaaatcaagctatattagttatgaaaaataaaataattgaaataggtaaactttaaataatttttaaaatatgaaaggtctcagactgaacaacccataataggtcaaagaggagcattaaggaaaagcacatacctatttgctatctgtggtgaatctgcacacatctacagcaatctcaattatttcctctgcagaaggaaaaaattcaaccaagggacataaggcagaatgaaagagtgaggtaaagtttagaataggagtgaaagttgattaaaaggctttagagtaggaatgaaaggaagtgaagtacacttggaagagggccaagcaggcaacttgagaaatcaactgtgtggtttgaactggagttttatacactggcgtgtgtattactccattttcacaatgctataaaaaaactacctgagactgggtaatttataaagaaaaaagacttaattgatttgcagttccacatggcttggaggcctcaggaacctgacaatcagggcagaagatgaagaggaagcaaggcatgtcttacacggctaccggagaaagagtgaggcagaaagtgccacatgctttcaaacaagatcttgtgagatctttactcactgtcactagcacagaaagggggaagtccatccccgtgatttaatcatttcctatgacaccccttcactgacacatggggattacaattcaagatgagatgtgggtggggacacagagccaaaccatatcattccacctctggaccattccaaatctcatgtccttctcacatttcaaaacacaatcacaccttcccaacagtccctcaaagtcttaactcattccaacattaacccaaaagtctaagtccaaagtctcatctgagacaaggcaaatcccttccacctatgagcctataaaattaaaagcaagttcattatttccaagataaaatgggggtgcaggcattgggtaaatgttcccattccaaatggaagaaattggccaaaacaaaggggccacaggtcccatgcaagtctgaaacccagtggggcactcattaaatcttaaagctctaaaatgatctcctttgactccatgtctcacatccttgtcaagatgatacaagggatagatcccaaggtcttggacacctctgcccctgtggctctgcagggtataccctcacagctgctttcacaagctgtcattgagtacctgctgcttttccaggcccatggtgtaagctgtcagtggatctaccattctgtggtctggagtatggtggccctcttctcacagctccaccaggcagtgtcccgggggacctctgtgtgggggctccaaccccacacttccccactgcactgccctagtggagattctccatgagggctctgcccctgcatcagacttctgctgagacatacaggcattttcatacatcctctgaaatctaggcagagcctcccaaactcttaccttctgtgcacctgcaggcccaacaacacgtggaagatgccaaggcttggggcttgcaccctctgaagcagtggcctgagctgtaccttgaccccttttagccatggctggagctggagctggaatggctgggacacaagacaccatgtcctaaggctgcacagaacagcgagcccctgtgtccagtctacaaaaccatttttccctcctaggcctccaggtctttgatgggaggagttgccatgaagatctctgaaatgccttggagacattttcctcactgtcttaaggattaacattcagttcccctttacttatgcaaatttctgaaaacactggtttgaattcctccccagtaaatgggtttttcttttctaccacatggtcccagcaaattttccaaacttacatgctctgctttccttttaaacataagttccaatttcagatcatctctttgtgaacacagatgactatacgtagttaggagcaaccaggccactttttaacaatgctccttagaaatttcttccaccagataccctaaatcctctctttgaagttcaaagttccacagatctctaggacagggagaaaatgccaccagtctctttgctaaagcgtagcaaatgttaccctactctagttcccaatatttgtgttgtctccatctgagaccacctcagcttggatttcattgtccatatcactattagcattttgatcaaaaccagttaacaagtctccacgaagttccaaactttcccacatcttactgtcctcttctgagccttctaaactgttccaacttctgcatgttatccagttccaaagtcgcttccacagttttagatatctttatagcagtgccccatgcctggtaccagttttctgtattcttctgttttcaaactactataaaaaactacccaagactgggtaatttataaagaaaaggggtttaattgactcacagctctgcatggctggagagaaaggaaacttagaatcatggaggaaggcaaagagaaagcaaggcctgtcttacatggcagcagaagagagagagagagagcaaagaaagccacacacatttaaaccatcagatctcatgagaactcactcactatcatgagaacagcaaagcagaagtctgccccccatggttcaatcacctcctatcaggcccctccccagacacattgggattacaattcaagatgagatttgaatagggacacaaagccaaaccatatcagcatgcttctggggtcttatattccttatcccctgattctttccttagggtgggctgtctgtatgtacagtggcctgctagctcttgggaggggagcatgcacagtgtttttactggaattgtatgcattctcacatgaggtatttttcccttaccagtcaaatgtccctagaaggtcatatgccagttaaactccaccatttttgtctcttaatgcacatgcttgaggacatttgcccaactcccaacttctgagatcttattggaaagctgctgatcaccagtttcaggtgtttctgtttattggaagactgcttttccctggcactggttgtgaccgattattatattagagagaaagttaacaactgcctgaccatcacctaatggttgcctgatatccttgggtgagggtagggggagtgggtggagggggataggggaatccctctcctgctctgctcatgtcctactagctacctgctgtaatatatccatgctaaaatggtatgtttgaatattaaaacaaagggaaattttttgaaagcttacagaaacacatgattacatataaaagatcaagaattggattgatggcgttttttaaatataaaaatgggaatgatacgataacaaaatactctcaaagtattgatgaagagtaaagaccagaatgttataaatagacaaactcttggtaagtctttaatatcaatagtcatttacttttatccagaaatcaaacatgaggtttctggagtggtgatcaaagttattatttaaagcaataactgtacttgtttccctgtgcttcatactccacaaattatgtgatgagagccagatattatgccatacgtgtggggatttatacttcaggagaggaaaactgaaattctaaatttggaaatttgtttggattagctaatcaacgggcaccttctcttctaagagaaggagataagtctaatctccacaatgtaaacaacttcttgagaagagaaatgaaaactccctgggttcctaatcttttgactgtaagtaagtatctctaggaagaagataagacatcatttcaatttataattctgaaaatttatctatggttctgggctttatctccctttaaaatttaaacacttatcttcaagcaggtaaatctacccagagttctttcacaatctattcaatcatcatttagctttcaagatttctcctttaacctagatttctgttttcttcactcaaaaagccctaagtatacacacaaaaatgtaaatattcacttcctgaagattgtcactcaaatatagggatgtgattaaaatattctcagactttcaatgccacagatatttgccacactaaaacctattctgaaaacagttctagaaaaagtacacaggttaaaaaaatccaggaaatattataagatatatatgaagaaacaaggatcaaaagcttgttaaaactatgtcacttaaaaatttttctaacaaaaaaagaggaaatataataataataaccaaaaaataaaagtctggagaatctcagcctgatgaagaagggtggaaggtgatgcatatgaaccgaaagatgtgagaactagctaaaattcttgccatttaaaacaagaacaagtataagttaaaaaaaataaacttagaaacagtagaaaaaactaaaacaagaaattaaagtgacagaaacagatacaaattcatcactaaccacaataaatgtaaatggattaaacaatacatttacagaatggataaagacatgaaataataaagacaatgcagcagaacatccaaagtatgagattgaaggtaagtaaaaagacataggcaaatgccaaaagaaagtatataggactaatttaatatctgataaaatgggtgtggatgtataaagtacagaaaccacctttgtaaaattatgataataagagaaatctgacatagttgactccatcttgcttgtaacctccaagcttgatcattcctgaccataggacaaactaatcttgggaagaacttatagtttaaccttaaagcaaggatgatgatagtcctttctgcaactaaactgcctttggaaaactaatgaaaagctacaggattagaattatgagagaggcctgaatgctgctaaaatgtaagcatagttaaatgataaccagccattttcctggaggttgcaaaatttgtaacttccccagatggttctatagatactatcactattgtagaatctaagattggttgtttgagaagtttttgcagacttttatattctgagaaccccacgtggacccatgactcatgatttaaccagccctgtggtccccaacccagagatagattcagcacatgagcatcattttccacacccttataatgacatccccaatcagtaggcagcacccaacccctagtccctttcccaccaaactgttcttgaaaaatcctaatcactgactctttggggagactgatttgagtgataactacattattcatgtagccggccttgtgtcaattaaagcctttctttactgcaacgccatggtctcagtgaagtgtttttttgtctttctgttcagcaggcaggaagaatccattgagcagttatagtacttattaaagatgaactatcattatctcctgaaaaatgtttcaacaaactaagatatagcaattttaaacatgtatgcacctaattttaaaatgcacttaatatttatttatttgtttatttatttatttatttatttatttattgtctgagacagagtctcattctgttgcccaggctggagtgcagtggcacgatctcagctcactgcaacctctgcctaccaggttcaagctattctcctgcctcagcctcctgagtggctgggattacaggtgcgcaccaccatgcccaggtaatttttgaatttttagtagagacagggtttagctatgttggccaggctggtctcaaactcctgacctcaagtgatctgcccaccttggcctccaaagttataggattacaggcgtgagccactgtgcccagcctaagatacacttaatttagaattaagggagaaactgataaatccactgtcatggatttcaacatatctcaattgataggttaagtacacaaaataatagaaaaaaatactgatctgaacacaattaacaaatttaaactagtgcacatagatgtagagttttacagccattaatcaaagaatgtatattttttctcaagcatatatggaagataaattatgatattgtatcataaaggaaataaagacaacacatttcaaaagtaccatagatactatacagatcttgatatctaatgacaatacaactgaagtaatttttttcaagatttaaaaatttttctttatatttgcaaattttaaacaaaaccctgttgaagaattcatgatgaataatgaaggagcaagataaataaataatttctagatttataagacaataaaggataatgaaaagcttacagagtaacacctaagagatgtggtcaacatgggctcaagtggtcctttgagagagatttatagccttaaatatctgtattagaaaagaaaaatctttaaaatcaattgtgctaataaatattttttttcttttttttttttattatactttaagttttagggtacatgtgcacattgtgcaggttagttacatatgtatacatgtgccgtgctggtgcgctgcacccactaactcgtcatctagcattagttatatctcccaatgctatccctcccccctcccaccaccccacaacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaaggacgtgaactcatccttttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctgtttctccacatcctctccagcacctgttgtttcctgactttttaatgattgccattctaactggtgtgagatggtatctcacagtggttttgatttgcatttctctgatggccagtgatgatgagcattttttcatgtgttttttggctgcataaatgtcttcttttgagaagtgtctgtccatgtccttcgcccactttttgctggggttgtttgtttttttcttgtaaatttgtttgagttcattgtagattgtggatattatccctttgtcagatgagtaggttgtgaaaattttctcccattttgtaggctgcctgttcactctgatggtagtttcttttgctgtgcagaagctctttattttagttagatcccatttgtcagttttgtcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagctttcccagcaccatttattaaatagggaatcctttccccattgcttgtttttctcaggtttgtcaaagatcagatagttgtaggtatgtggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagttattggtagcttgatggggatggcattgaatctgtaaattaccttgggcagtatggccattttcacgatattgattcttcctacccatgagcatggaatgttcttccatttgtttgtatcctcttttatttctttgagcagtggtttgtagttgtccttgaagaggtccttcacatcccttgtaagttggattcctaggtattttattctctttgaagcaattgtgaatgggagttcactcatgatttggctctccgtttgtgtgttgttggtgtataagaatgcttgtgatttttgtacattgattttgtatcctgagactttgctgaagttgcctatcagcttaaggagattttgggctgagacaatggggttttctagatatacaatcatgtcatctgcaaacagggacaatttaacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagataggtcttatcattttgaaatacgtcccagcaatacctaatttattgagagtttttagcatgaagggttgttgaattttgtcaaaggctttttctgcatctattgagataatcatgtggtttttgtctttggctctgtttatatgctggattacgtttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctctttttttgttgtgtctctgcccggctttggtgtcagaatgatgctggcctcataaaatgagttagggaggattccctcttgttctattgattggaatagtttcagaaggaatggtaccagttcctccttgtacctctggtagaattcggctgtgaatccacctggtcctggactctttttggttggcaaactattgattattgccacaatttcagatcctgttattggtctattcagagatgcaacttcttcctggtttagtcttgggagagtgtatgtgttgaggaatttatccatttcttctagattttccagtttatttgcgtagaggtgtttgtagtattctctgatggtagtttgtatttctgtgggatcggtggtgatatcccctttatcattttttattgtgtctatttgattcttctctctttttttctttattagtcttgttagcagtctatcaattttgttgatcctttcaaaaaaccagctcctggattcattgattttttgaatggttttttgtgtctctatttccttcagttctgctctgattttagttatatcttgccttctgctagcttttgaatgtgtttgctcttgcttttctagttcttttaattgtgatgttagggtgtcaattttggatctttcctgctttctcttgtgggtatttagtgctataaatttccctctacacactgctttgaatgtgtcccagagattctggtatgtcgtgtctttgttctcgttggtttcaaagaacatctttatttctgccttcatttcgttatgtaccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatatatattctgttgatttggggtggagagttctgtagatgtctattaggtccgcttggtgcagagctgagttcaattcctggatatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgtttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactctttatccaatttgccagtctgtgtcttttaattggagaatttagtccatttacatttaaagttaatattgttgcatgtgaatttgatcctgtcattatgatgttagctggtgattttgctcgttagttgacgcagtttcttcctagtcttgatggtctttacattttggcatgattttgcagcagctggtaccgtttgttcctttccatgtttagcgcttccttcaggagctcttttagggcaggcctggtggtgacaaaatctctcagcatttgcttgtctgtaaagtatttaatttctccttcacttatgaagcttagtttggctggatatgaaattctgggttgaaaattcttttctttaagaatgttgaatattggcccccactctcttctggcttgtagggtttctgccaagagatccgctgttagtctgatgggcttccctttgagggtaacccgacctttctctctggctgcccttaacattttttccttcatttcaactttggtgaatctgacaattatgtgtcttggagttgctcttcttgaggagaatctttgtggcgttctctgtatttcctgaatctgaacattggcctgccttgctagattggggaagttctcctggataatatcctgcagagtgttttccaacttggttccattctccccatcactttcaggtacaccaatcagacgtagatttggtcttttcacatagtcgcatatttcttggaggctttgctcatttcttttcattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatatattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggttttcagtgtgtatgtcctttctgtttgttagttttccttctaacagacaggaccctcagctgcaggtctgttggaataccctgccgtgtgaggtgtcagtgttcccctgctgcggggtgcctcccagttaggctgctcgggggtcaggggtcagggacccacttgaggaggcagtctgccggttctcagatctccagctgcgtgctgggagaaccactgctctcttcaaagctgtcagacagggacatttaagtctgcagaggttactgctgtctttttgtttgtctgtgccctgcccccagcggtggagcctacagtggcaggcaggcccccttgaactgtggtgggctccaccctgttcgagcttcccggctgctttgtttacctaagcaagcctgggcaatggcgggcgcccctcccccagcctcgctgccgccttgcagtttgatctcagactgctgtgctagcaatcagtgagattctgtgggcgtaggaccctccgagccaggtgtgggatatagtctcgtggtgcgccgttttttaagccggtctgaaaagcgcaatattcgggtgggagtgacccgattttccaggtgcgtccgtcacccctttctttgactcagaaagggaactccctgaccccttgcacttcccaggtgaggcaatgcctcgccctgcttcggctcgcacacggtgtgcgcacccactggcctgcgcccactgtctggcactccctagtgagatgaacctggtacctcagatggaaatgcagaaatcacccgtcttctgcgtcgctcacgctgggagctgtagacgggagctgttcctattcggccatcttggctcctccccgagaatcagctaataaatatttttagaaaatgaataatgcagtgaaaatgggaaaaataataaaaataagagttgtgattaatgcaatagaaaggtgctgttttatttaactagaatatgattataaagcaaacatatcaaatagaaataaacaaccatctggagcagagaacggaaagagatttttgcttaacctttctcattctcagaaaaattaattccattttccccttctccttcacgtcagctcttccctctgctttaaactatagggtctgctgccatgcaaaaggtgagtaccatcctatgacaaagagtggcaagcctagaaagtcaaaggaacccatccacagagcacccacagacatcctgttgggaaccactgactgtgtgggtttaatttgctcgtacatactgcctcatagagagaaaaataaaatttggagaaatcagaagttattaaacacaagtactcaaaaggattggcacagactggtgctgagcagtctagcaaaggaggtcatgatgtacaccagcttccttcagcctttgccagcagtatatgctcatctcatcattaagcaaggctcttaaaatccccaaagagcagacctctttttgtggagattaaataaagattttagcttgaatttctatatctttaacttgtgttaaatctaaacccttgcagacttccttattttccacccaattaatgcataacatggttcagtagctctgactttaccctggtagcctgattatggtaatgtgaacattggctcataccactgttcctaagagtgctgtgctgtgttggagccaaacatcagaaacaatctctcattgttgtgggatggagggtggagatatatttgcatgtgtgtagatatatatattgatatgtgtgtgtgtgtgtgtgtgtgtgtgtacgtatacataaaacgatggattttgacccaggaagaggaagagtggtggctgaagcaccaggaactcatgtacttgttctttgtacacaccaggagaatcagggttgaaatactcttcctctctcctgacagtctggtgttatttaggattaaagtgctctagttcagtggtccccaaacttgctcatcactaagagtcacctacgtgctagttaaaactatacattactgaaactttctctagagcttctgttttgtttggtcggggatatagcctaggtttctgtatttttaacttgtgtacctagggcaactttatgattagacatgtttggaaaacattgctctacctagttccaaggtctaacaattttaaactgaatgttcacatagccttttgggattattcttattgttgtccataagacttacctgacttctccaataaccccaggagaagaatgtggtattcattagtttgccatatttacttagtatacctctatttcttaacctctttaagcctggttttcccacttgaaacatggagagaatagtaataataatacctatctcagagagatttttacagaatgcaataaactaatgcttataaaacacttaacataggacctagaacaaagtaaggctgcaataacatcagctatgattattattatttcataccacacactttttacttgcctaatgtgataaatcatttggaaaagtgttgccattattctcttctctgtaccagggctctatgccatgtggctttgtagcaactcccatcaggagatgaagattacttcccttacacttgaaactgggatggttctgtcaattgcctgaaaaattgaatgtgatgacaaaagcaaaattgtgctagttttgggcctaggcttcaagaggccttgtgtacttttactctatgacaaggtcattctagcctgctaaaagatgagagacaatgagggcaaggccagtgagccagctgtccccgccctggtcccagagatgtagtgaagcctagccaagatcaacaaagtgctactcaacctacagctgactagaggcaaatgagtgaacccagcagacaacagaaaacccacccagttgacccaagaactcatgactaataataagaggtgattgtgctaaggtactaagttttggggtaaatttggtacacaggcatagatctggtacatcgattatgtgccaattactaagttacatattagagatgcatagggaaataaggcacagtcctggttctcaaaaaccaaaagcatgtttttgcaaaagacaagtaaacacaattttagaatacagttatgcaaggctcaattatatatatttttttatttcattcactcaaaaaataattttacaatttctgatatttgtcatgcactgttctagacacttgaggtatatcagtgatatggtttggctctgtctcctcacccaaatctcatgttgaattgtaatccccacgtgttgaaggaggggcctggtgggaggtgattgaatcatggggatggagttccccttgctgttcacatgatagagttctcatgagatctggttgtttgaaagtgtgtagcacttccccctttgctttctttctcctgctgccatgtgaagacgtgcttgcttccccttcgctcttctgctatgattctaagtttcctgaggcctcccagccatgcttcctgtacaccctgaggaattgtgagtcaattaaacctcttttcttcataaattatccagcctcaggtagttctttatagcagtgtgagaatggattaatacaattggtaaccaaatcaaacaaaaatcccttccccatagaaaaaaaaatgttataagtaagtatattaacaggatattagaaggtgacaagttctgtttaaaaaaaattcaggaaacataaaaccggtaagaaggatcaggaatatgggacacagtgggtggaaatcagattgcagtattaaatggggtgtctggtaaggctttgttgaggaaagttgagcaaaaacttgaaaaagatgagaaagttaaacaatctttccaaagagatcaatgagataaggtgaaggccctaaggtagaaaagtgtctacaatttttgggtaacagaaactaggccagtgtaactaaagcagaaagcacaaagtaggccatacaaactagcctgtaagaatacttttttaaaataaaagctcctgaaggatgtgacaggagttcagtgttgaagcaagcacaggagttagcagggatagtggagaaaggcacccaggatgtggtgggagggagatagatgaatgagaactccaaggagaagaccagaacacatgcagagaaactaagacaatgttcatggttagtgtgaactctcggggaattggaagtatttcataggattggagaacaaaagagtgatacaaaattatttttaaaagcaggcggaccatatactggaagacattgaatggaaggctaaggaggttcagttttacctggatgtcagtggagaagcattgaagagttgaagcaagagagaagtgattttattagactagctttgaaagatcattcagtttagcatggaaaatgagttggaaaggagtgaagaaacaagtcggaagactacttagaatctttactgatggccctttcaagaaatgaggatagagaggagggtgtggagtcaagcaatgtaaaaaatgtgacaggatagggtgaatgggactggggcagtggaacaactgtagtacttcaagttttagatcacaatcacttcagggtctttaggagatgagatattttaatggccaatgcaaagagtaacatcatttatttatgcattcatttccttaaatatttaatcaatgcctaggatgtgtctaggtaatattaaacagtaggaatataaagagtagtgatgcagttacatcaccaaggactacacagtcctaacactggctcatcaccccctaaaactaacactggctcatcacctccaaaacaactgccagtgagtggttattgtatgcaaagcaggtattgagtctttacaaggatcgttttaatgaatcatcacaatggcattttgaagtaatactattatccccattgtacagaagaagatattttactttgagagattgacttggccaaaatcacacatttagtaagtggcagagctaatacctgaatctaggactatctgtcgcagtcccatgctacatggaaacccagacctacgaatcagtaaatgtattaaaggaaataatcaattttccctgacagagtggtttgaaagccttcaaagtggtgattcttgatttgagtttttacaggtaagcagatttcctccaggcagccagggaggaaaggagagtgaaagggcacaagcagcgtgttctgcggaagggcagctgtgctgcatcagctccacctgtttctccatatttactctaattctctttcacctcctctctgccccagaaggctgactgctatggactgcacaactttagcttctttgggggctgactgaatttgactggctgtagattggaatgtgggaatcaggaaaaatcagaattaatattttcctggctccctccatgcaaggccacaagttgacaattgctgcgttcttgtatcaaaggctacatctgctggacattcctcccctcagttctcttcattcaaaactacagttctcttcacttctagccactgcgtcttcctctcaccttcaggcctgcaggcctgaatggctccacatgttgccagggcttgaatgttccatcatccctctgagttgcttaactctgccccgcaccttttggaaatagcgtccccctcagtttcattctctctgcctctgcttctctctctcccgggcatgtacacacattcccttaactaatagctttattgagatataattcacatagcatatcaatttattcatttatcgtacacaattcaaagatttttagtacagagtcgtgcaaccatcaccacagtcagttttagaatattcccatcacccaaaatggaaactttgtagtgtttaacagtcgtcttcccgttccaacccccagccctaaacaaccactcatctactttctatctgcatagatttgattaatgtgacatttcatataaatgaaatcataaaatgtatggttcttttgggactggcttctttcacttaacataatgcttttaaggttcatctatgttgtagcatatatcagtattttatttctatttattgctgaataatattttggggctataccacattttatttatcaattaattgatgaacagttcaatcatttccaatttttgaccatcatgaataatgtatgaaaatctgtgtacaaggtttcacatgaacctctatgtttatttgctgagtacatatctatgaccataattactgggttatatgacactctatgtttaatcttttgagaaactaccagactgtttcacaaagtgactgcaccattttacattcccatcagcaatatgtgaagatcctaattttccatgtccttggcaacagttattagctgtctttttgttttcttataatcctctaaataggtacgcagtggtatctcattgaggtttggctttgcagtcttctgatggctaataatactgaatatccttttatgtaattattgactattcatttttctgttttggagaaatatctattcagatcctttgctcttgttatatctctcaatctcttaagcaattcatttgtctcctgtgtttcttgttaggacccccattgatacatattacaaagactatccagatttatagaacatgccttacttcaaggtgcacacattcagcaaaagatttagggcaagccacttgtgctagttgtgaaaaacaaaaagaagaaaatcatttttatattactacactgactttggtgatttcttttgaattgaggctgtatctcaacatgataccttaatcatctagtttttaattgaatcatttactagtcaaccatcctaaaaacacagactagttacctttcagtccaggtcacagaaagtggaattttagggctccagttttgtcagtgcaaactttcccaatgagaaaaagtcctgacagttgtaacacttaaatttttaaaaagctgcaagtgacattgatggtggcttcttctccttatcaaaatgacttagactttggtaagacccagcagctccaataacgttagggtttgggaccacacagatctgggtttgtatatcttctgtataatttaccatttgcttaactttagacaagttacttgagccctttaaacctgttttcttgtctgtaaaattagggtaagtgtaccactatatataaaatagttgtgttatgtaagtaaaataatgcaaattagacacctggaaagagtaatatttaataattatttctttttccacttgtccttacagtgctttttcatgttaatctggttctgaaaagtatccctttccccaataatgctaagtacatgataccagactatgcagttacgttataaatgatacatttaatctctgttttaggtgaacccatttaattatatgcattattatttaaaaattctaaaatatattgaatctctcactccttttttttcccaacaacagttaataagacaaagtgttagcctcatagtatttttgttctagttatgaaaacagacaaactatttattcatttataaaattgtaggccaaaaaatagaattgtgtttagtgtctgtctaccaaaccataagtttcagaaaccttataacaacctatagcattgtaatttatctataacatgaattggatcacaagaatgggaaaagttgcattatattctctatttatgattgtaagctcattaatatcacatattgacaaaatgccaagggaaacagaatagtttcctttttaactaactccaagagctgatgaattatgaatatgaagtgaagggcctatctcataaaactaatgctatatctcaaggaagccagagaaaagctctgacctttaggaacacaatgaatttatagaaaaccagtcctccaggcatccaccctgaaaagtgcactcttatctacaaaccacagagagaagctacactcttaactcaaataatagccacgtctccctcctgaaaattgtggagctattcttggactacaaaagcatccaattgtgagaagagcagcagaggaagctactaaggcctttagattggtccctgcaagtagagaatttttttttcccctgagtgtaaatggaatatcaaacgagcacattttaaacatacaggattttggcaattgtgaagttttgttctggatgctcttgtccttaaattatattataatcatattagtaaagtgagccagtttgtactcaataccatactttattctttcttgccagtccttactaaattcagcctacgaaatattctttcctgcctcttgattaaaactcaagtaaattccatagcttttccaatcactcgtctttttttttttaccgtcttatttacatttttaaacctcacttccgccccagcattgcgtattctttgtgccatattttcctgccttttaataaataattcactgattttatttatctcctatcttccttcactggtaagttccttgagggtaaggaccttttctttttctgtgtagtgtatgtatgtgtgtatgtgtgtgtttgtactaatttattctttgaacctgaaacagtggctagtacactggaggcactcaagaaatatttgttgaatggaaaagtgaattagtgtattagtctgttcttgcttgctataaagaaatacctgagactgtgtaatttacaaagaaaatagatttaattggttcacagtttcacaggctgtacaggaagattggtgggggaggcttcatgaagcttttacttacagcaaaaggcaaagcgggagagggagtcttaccatggccagcgcaggaggaaaagagaaagtgggcaggggcttcacacttttaaacaaccagatctccagagaacagcactagagggatggtgctacgccattagaaactacccccatgatccagtcacctccctcaaggccccacctccaacactggggattacaattcaaaatgagatttggtggggacacagatccaaaacatatcaattagaagtctaaattctcatctagttaagacgtttctcttccctcatcctggcctcaccttaagcaggacactgtaatgcaaacgaaaggaaggtgtaggcagcttctctgtttttcactccctttcttggtctactaatcagctgctacttataactgcaagaggctgatgcagaagcaggatgtgaggtaagagaatacaaaattacttatggctgtaatttttcatcaaggtcaccttcataacaactgtgacagattcagtgtttgttaggttcctttgtggagaatttttgtgagttcttagaagactccacattgccgagctcctctcactgcctgatgtaggtggatagcttgactggtaggctgcctgtgacatgacttaatttctgcatctaactgttttctttgcagtgtctccgattaaaataatatatccttattataaaaagtggtatagttatataacaaaggattataaaggcaaaataaaaccctttcttttatcccacacctcaaactccaccaggtaatcaatgttaataacattttcccacaactttctccttgtttgtatatatgtagacacctgtacatgcaaatatgggatgcagttgtgtatatgtttattgttacttagttaaaactatgttacttagttacttagttaaaaactgttacttagttactatgttacttagttaactatgttacttagtttaactatgttacttagttataactgttcaatacattgacaacatatcatgatcaccattttttctaatgcccttattcagatacaatcaggatattgaacaagtatgattaagatatacataatcaaacaaactttgctttttgtctcttgtttcacactttaacatttatttaaggagtttaatctttccttgctcctgggcattgtgaattcagaaaatctgagacaggtctcagttaattaattaattaattattattattattagagacaaagtttgctcttgttgcccaggctggaacgagattttgcaatggcgaaatctcggctcactgcaacctctgcctcctgggttcaagcgattctcctgcctcagcctcccaagcctgggattacaggcatgtgccaccatgcccaactaatttttttatttttagtagagacggggtttcaccatgttggtcaggctggtcttgatctccagacctcaggtgatccacctgccttggcctctcaaagcgctgggatttcaggcgtgagccaccacacctggccaggtctcagttaatttagaaagtttattttgccaaggttgagaacaggacatgcccatgtcacagcctcaggaagtcctgatgacatgtgcccaaggtggtcagggcacagcttggttttatacagtttagggagacatgagacatcaatcaatatatgtaagaagtacattggttcggtctggaaaggccggacaacttgaagcaaaggcaggaagactaaagggaggagggaccatccaagtcacagataggtgagacacaaacaattacattcttttgagattctgattagcttttccaaaggaggcaaatcagatatgcatctatctcagtgagcagaggggtgactgactttaaatagaatgggaggcaggtttgccctaagctgtttccagcttgagttttcttagtgactttggggacccaagatattttcctttcacagcatgaacttcaggtcactttaagtgtctgaaatgaaaactcaactagacatacataacattcattgccagatattcagatttgattcaacattaaaatcttctcccctttccctgttaaaatctactttatttatttatttatttatttatttattgtaagttttgtttagacacaattactgcacatcatgtgagaaaaatattcaacttcacttcctttcatattgatgacccttgtgccaacagcatctattgaataaactctttacccttcttgctcaaatgaagtaacatttttacccatttgtacatattacattttcaaatatataaggttgatttacaggtttttctgttctttgcaattgacttgtttattctcatgttaatattatagtgattaaaagtgactggtatatggcccaacaccagtaagacaagacttcttccctcactattcctctttttcatgctttccctggtttatctctggcattttgacttcttcattacatagctggatccaattctctccaacacccaccatctggctggcattttattaataaattgaattgcattacatttatatattaatttagggatgtgtgatatttttatgacatcaaatattcttatttaaaaacatgaaatgctttttcaattatttagatcttgttttattttcatcactaatattttacagttttatttttataggtctgacatgtttcttattaaatatactcctaggctttatatggtttttattgctagagtgaatgttattttcatttctacttctagcagtttatgcctaagatagagaaaacctatttatttttgtataccatacttaacgttctaacagccacctatgcacttcttattaatcctggaagtttctgtgcacctctttactgtcacacaatcacattattggtcaaaaaaagtaatgataaaataacttaactcttccttatacattttttaaaaattaacattttgtttgttagttcctttgaggcaatggtaatagcaggcattcctgctgactggtttataattttcattgaaatagttttaggtttgctgtttgaatgatttaatgttaatttttggtaaaaagtctttttaaaaaaatattttatttctttatttatttttacactgggttatcagaccgtctaatttttgttgttgttgttgtttgtttgtttgaggcagagtctcattttgttgcccaggctggagctggagtgcagtagtgcaatctcagctcactgcaacctccgattcctgggttcaagtgattctcctgcctcagcatcctgagcaggggactacaggcgtgtactaccatgcccagctaatttttttatttttagtagagatgaagttttgccatgtcggccaggctggtcttgaactcctggcctcaagcagtccatccaccttggcccccaaaagtgctaggattacaggcatgagtcaccgcaccagccaggtaaagtatttttacaatatttaagtgacattctatttttatcagtgttttcattaagaatgacaggtaaattttatcagatgcttttttagcatctactgttatgatcacataatatttctctcttagtttgtggatataataaattacattaagagatttcatagtaattgtgccacccttgcattcctggaataagccttttattgctcatcgtgcagcactattttgatatattgctggagtctctttgctaatattcacttagaatttgtgcttctatattaaatagtaagattaatgtatgtgttgtgggatcagtttttgactttaaagttattctgatttaataaaattttttggtgatgttgagacctttttatgggttggaataaattaaacactaataggagcatatattaattaaactttagatagaatacagttgtgaagccacttgatctggatcctcttttattaacatatctgtaatgacattttattttttctttcttttttttttttttttgagacgttgtctcgctctgtcgcccaggttggagtgcagtggcgcgatctaggctcactgcaaactccgcctcccgggttcctgccattctcctgcctcagcctcctgaggagagtagctgggactacaggcacccaccaccatgcccggctaattttttttgtattttttagtacagatggggtttcaccgtgttagccagaatggtcttgatctcctgaccttgtgatccacctgccttggcctcccaaagtgctgggattacaggtgtgagccaccacgcccggcctgtaatgacattttcaatcttttctatgttaattaatatatttgttgtaagttaaatcttactaagaaattattttctctaagttttcaaatttattttaccttatcctgttttgtcattcttattatttttctgttttattaactttaggttttattttattaatttcctcttcctcccttcttttggtatattatattgtactttatctcattaaaattttaaggtgggtatccagacagaaatttacctttctatttatctgcttagtgcctttggcaccactcttatatttagcaagtttctaaatttaaaagacacttcagattagaaattgaaattataatttgtttgtctaggctcctttcctgcaagggtgcaggcagctatactgtagatgacatagcacacagattagaataatctatctatatgagaatttagcagctcatgatgtggtgccccagtatggggaggtggttggtgtgtgtgtctagtggcccctgaatatgggagccctgtaagagaagtggttggggtggggacttagcgaactgcccaaagaaaggaaatgagagttttaaatcacaacttcaaaactgggttcagatagcacttgtaaagtacattataccagaggtatcagctttttgacacagcagtgacaggtggaagatttggggctcaaacttgggtgcttcctcttggcagagtgagcagggtttcataggaggaacccagtgctgtaagtttggaggcgtgtgtcctccaaacttgattctctggatctcctggagattctcagacatactgtatttgtagtcaggggtctacaaagaaatggagccaatggaatatatacgtacgaaattggctcacttggctacggattagatgaagtcccacaatctgcagggtggattggaaatgtgaagtccccaggaggtcagatggtatcatctcatacatcatacaaagggttagcaggcttgagaccgaggtagagtaatgttttggtctgagtctcaaaataggaacaaaaccccaatgtcgcagcttaaaggctgtcagacagaagaaatgtatcttactcaggggagggttagccttttgttcttttcaggccttcaactgactggatgaggcccgctcacattagggagagcaacccgctttacttgatcatctacttatctgaatgttaatttcatccaaaaacactttcacagaacacgcagaatgatgtctgaccaaatatttgagcaacatgtggcccagtcaggttgacacataaaatgaatcatcacacatcctatgatacatttattttctattttctagattaggtcctataaatttttctgaatcccactaaaactcatgactgatacaagtaccagttttattttaatatttaatcttttatcttcaataatatatttaagtctaacactatgtatttttctccgagaagaacttttgatatggccaatagatttttgtatagccatttctcatttccattatttcttagatactatttttatactgaaattactttttggttttaccactatcttaaagttaattttctaatttttatgtaataaagtaccttcataaaccttatatctggtcaacattagaaaattgatctgtaagacttatactttttaaaattgaaaggtggttttgtgtttaggtttgtaaacacaatgtttagaagctcaatgatgtaagcaaaatacaagagttctatatatctttatcaaatttgagattcgagtattattattcatttctgatttataaggcctgttctattcttgtggaaatatcttgaaatctactatttctgataagttctttttgctcctacatggtttttattttacatatgtatagggctcattgagatttatattttttaaaaaaaattttgctttttaaaataaattacaaaatgtcattcttcattctgatgggtgaatttaaccttaaactccttcctgtatattacttctagccactacttgtatgtatgtgtgcatgtgtgcacgtgccctcatgtgtgtgggtgtgtatgtgcacatgggtgtcagtgtgtatgtttgtgtgtgggggctgcgtgtgggtgtgtgtatatggtcgcagctacatttgaataataactctttaattgtcttttaatgtcagcccagctttaatactttgtttttataaacagcataaagtttttaaaaagtcttaatattgcattctgtactttaaaaggcaatacttatgtaatttaattgatttgatttgattactgacattttgctgtatatgtattatttattttgctttattattttcttgttcccttataaaaataaaaaaaaacggtttcaccaatttacttcttacctccttttttcttatatgagagttttactgcatttttctattctatcaaagcttgcattttttctaatatttatacacatttctctagtatcgtatgaaaagaagaaactaacaattcaacagggaatacttttactcttttattctccttcttattctatgtcccattccttttctgctcattgtcccccacgtttaaaattttgctgagctaactttgtattttaaagttcagatcttttttttttttaattatcttgcagcttctcacatctattttaaaaattcctatgtaagcctgatatgttttgaatgctttgtcctctgcaaatttcattttgaaatgtggtccccaatgttggaagtggggcatggtgggaggttttagagtcatggggctgatccctcatgaatggcttggtgccatcctgggagtaatgagtgagttctcactctgagttgacatgagatctggttgtttaaaagatcctggcacttcctcctttctctctctctcctgctcttgccatatgacatgctggctccctttcaccttctgccacgatcgtagcttccttaggccctcactggaagcagatgctggtactctgcttcatgtacagcctgcaaaactgtgagcaaaataaacttcttttctttataaattactaagtctcatgtattcctttgtagcaacagacactgacacaaagccatttatattttgtgtttcactttggcaatattaaaacaaaaacattttattgcatttctgcaaaaacaaaggccaaaatctgcgtgaagatgtcagtgaagaagttcccagaatccatgtagatcagaacatgaagctaggagaaggagaggcctccaagtaagaaggtagggcagggtgagttgatgtagctgtctttaagcagactgcttgtgcacatttcaatcccacttcttcagggaaataaatggagcttttgatagatcttgggcatggtatataatgtcaagagcaagggatttatagccacatagacttggactcaaattactcctctgtcacttttttccaggtgacaccaggcagttactagcctccagaggttcagtttcctatctgtgaaaaggaaatagtaataatcatctcacaggattgctatgaaaatatgtaagagcacagtcctctgaggtaatatcattaggcacccaactaacatgtggatccctgtctttccttggtcagaactgtatgttgatacttgctttcagacagtaaaactaatttgaaattcaaacctcacatctctcctgctgagaagaggaacaatgggaaaaataacaccttttccctccagccaggcatgtctgcttccatttttcggttcactttttgtctttgaccagacacacatatagagttggaagtaccttgaaatgacagatttgtgttttgcaaaaatattctcttggctttgataggcaaatacttcttgacttacctcttcgtagtaagagatgtgtaaatcactagagtcttagatttgaacccaagatctagtcaactacaaaataaaacaaaaacccaagatagctgagggacataattaaattttgattaatctggtatcttagagtgtctctaggcaatactaacctcttacaaaatgatttattgcctaacatgtcagcttgggaaatacatgtttccagctgaaagagaattttatagggtaataggcccacactctacctccaggcaaaaagttttctaatattgtctctactaaactctctctacttctttttctttttatagctcagatttgaattcttttctggtgagcaaatattaaataaaagcttgtttctcaaatgtaattcatcaaggagattttggttaccctcacccaaaaagttatctattgaaatacttttttctcaccatcagaatgaaatgaacactatattttggttaccttatggtacctgcattgtagataagtataaatcttgtgattttatttttttaaagctttgtatagcatagccttgtattagtatcaccttcccccatgtcagctgtgtggtcttgttctaagtatgtactttggataacccttcatcaggtggcagtggtcctcaaattgtggactacttttgcatcatctgaaacttgttagagatgaaaattttcaagcccccactccagtctgactgagtttgagactcagtgttctatatttgaaaagctctccagcagaatatgatgcatgctaaagtttgagaaccactgggtaagaggacagatcataatcatccagagcccatagttctggattgggttcactcttggtgttatacagtctataggtttgggcaaatttttatggcatgtagccaccattctcatacacagtattttcactgccttaaacttcctctgtgctctgtctcttcaccttttcctgcctcctcaactacagttttaaggattttaagataaaggaagaaattatagcctttatatcattcattcaggcatttcttcaatctatagaagtgtgagacttattttataaaaaatctgggtaagtaggaagcacttttataaaatatggggagaaagagaagggcgtggatgtcagagtcctgtttggacatcttttcttgtgaaagagcacctcaagaagaaaaacacatcattgctaataagcctgtcactcataaacagcatccttcagggatctccctgtgggcctggcagaagtgagagtgatctctcaaatttcttactggctttgaggagcaaacacctgagatcttttagaattaaaattggcaggtcctttcagaatcctgcctttatctccctccaaatctgagactgataaacaaacaattcattcatccactgcctgaggcatcccctattgcttcccgggtaagacttggttcagttcagtcctgaaaatagtcacattgtttcttgtggaaactaaaaatctgacagtcagctgcctctcaggacagttcagtctcacatcttagcagcttctctgagccatctgcaactgataagcttccagatcaaaggccaaaggccccacctggcagggatcagaccttagtgaaggaaaggagaaactcgagaaactgttgagctgaactgtttccttttagataaaacttttgttattagacgtgccgttatatttagccatagtatttcagaaattctatagaccaggacattgatttcaataggagcaaggctaagaacttggtaaaacaattagtttagaattatttctcaaatggaatgttttcctgactttcacggttacttcctttactcagactactgtcatcattgtttgcttggcttagtgaaagggtctcctaaaccatctctagggcttccagttgttcccaaactcaggtgacaacaaactgtcagtcatttgaagagcagattcctggatcttatctacagagatgcattcttaacaaataccaagggatcgctgtattagtctacaagagaaagagatttaattgactccgagttccacatggcttgagaggcctcacaatcatggcggaaggtgaaggggaagcaagacatgcttagatggcagcaggtaagagggtgtgtgcagggcaattcccctttataaaaccatcagatcttatgagacttatttactatcatgagaatagcatgggaaaactcctcctccagggttcagttacctcccaccaggtccctcctaggacacgtgggatttgggagctacaattcaagatgaggtttaagtggggacgcagtcaaaccatatcaggatccagaccacattttgatgaacattattaactccatctccctctctccattgtctctgcttccagagccctcgttctatagtgcaaacctaaccatgtcagtctgctccaagaaaatagttcacagtgattcaataccttacaaaataagcacaggctcttagccagcaatagtagatatctttttacatgtataaaggcctgatttttttttctataatgtaggtaagacaaattataaaagtagatatgctgcaagaaattcaagaaatgacagatgtggaaacctttacataggaaatcactaagtacaaaagataagaaagatgaagccaagaatgagactagtactgagaaagcatggagtgaaacacatatatatacatatacacatatatattgtatgtagaggtgtatgtgtgtgtgtgtgtgtatatatatatatatatatatatatatatatatatagtttatgaggagaactatcttcttgttactgaaaccagagagaatgtgttcctgtgggtagtaaaggaaattaaaatattttacctccaaatatatttcttttacgtattttgaggtggctgtttcaagagcctgcaaacagaagtaaccttgcaaagctgtattttgtcctgggggaacggaagaggcagggatttgcatctctagagaatctaccttgatacagccaggttttctctgtggccttcacttgtccgatctaggaaagattaactgagaatctaattacttcaaagatctaaaagaaacatttactatctattctctctgagggctgctacctgtgaagtttatttacataacaagaccacctttgctagccaggcctcatcttctcccccaacaccctccctcccccatagcccatagcttattttgccactgtcttaggctgttcttgtgtcactataaaaaaaaaacctgagaatgggtggcttataaaggaaagaggttaaattggctcacagttctgcaggttgtataggaagcatggtgccggcatctgctcggcttctcgggatgcctcaggaagctttcgctcatggtggaaggtgaagcttgagcaggcacagcatatggcaagaggaggagtggagagagagaaagagacagacagagaggaagagtagggtttacacatgtaaaccaccagatttcactcactattgtgaggacagcaccaagccatgagagatctgcccccatgacccaaatacttccaccaggccccacccccaacattggggattacaaatcaacataagatttgaaagggacataggttcaaactatatcagccaccatagcctggtttgcaaggatccaagcacacattcttttggtaaactcaagatggtatataggcttctgaaccccactgggggattgggtaatcattctgtggttctcccccatgtgcatattaataaatgtgtatgccttttctcgaatctgccttttgtgagttgacttttcagcaaaactttacagggcaaagaagaagtattcccttggccccgacagtaagacaccttaaaatataatgaataatatcctcataataaatacagcaatcagtttcctagggctgtttcacatgtcctcacctgttgatcagtggtataaggcctggcataaaaactggcatataaaaactaacctgaagcacagttctacaatgctttggtagaacggggtgttcttctcacctctgacttaattgagggatatatttttaaactgtctaaaatagaattctacaaaatttagtaggagtggggtatgagttaaacaaaaatttattaaattctaacccacagccataaataactctccctccactgagctttaagtagatattatgtagtaataaatttcatgttgtactcagataaattcctggagtgcaaacttgtataatgttgttaaagtgtatgcagacataattgaacaaccctcgggtatgggatagaatttccattctattgtaaaaattgagtagcctaacagtcacaaaactcccctcaaaagcccttttctgaggtggcccaaggcagtatgtctaggcaggagaaattatgctcaagaagtaaaatttcgtcttcccaaacacaaagaactaatgcaaccagttccataattaacctggaacatttgtaaaatagattgatgtaactctttttgaagaatgtggttatcctcattttgtgatgacaaaatgaagcttaagagaagtgaagtaactcggctagtaagtaacaaagctgagattcaaacccatatctggttgtctgcaaagcccatctttttaactcctacactacactactctttttcaaaaaccatttctaccaaccctgactcccgtgatattaagatgcctcattaatggacagaattcatattgaacttacttgtctagtccataatcaagttctcttcatagaattgaagactggggaacattagcacagtgtatgaggccttcgtagtttagctagtactacttatccagtcacccctatgcatctactctggtctcaagtataccaaaccacttgtaccatgctcttctgccatatacctcagcataccattgattctacacagaatgctctctcctctaatgcaacaggcaggcttctagtcactcttcaagtctcaattcaaacatttcatctaattttttgctgtgggataatatagcttatataaaagtgggaggcatatatttgtccagattgttttaatacataccatagggatggttagttagcattttgaagtaccctgataaataactgacagtctgtgagtaggtatttagtacttcatatattgttatttgaatctataccaaaggatttataaatcagcaaaaggatagtagaatttgtttttttgtttttgtgaaatcaacacttcttaaggtaagtggtaagttaggatactttctaaaggccacatacacctgcataaaagtagtacagaataaaaacaatgggtacatccatagactagacgaatatcatcagtgcaccacttaagttccagagcccagttagtcttatgtccttccacttttggagcctggttagtcctgttatcagaagatatttgtatcaaccttcaaagtaaaactttcttgcaattaagacagagagtggtacttgcctaagccctgagaacaagctgttttactgttttgtgctgatttttcagtagatgtacatacattcaacagaatttggtctaagatttgctttcatcataatatgccacctggtgtgatggtagagagtaatgatagttatcaaccctacataccactagtcacaaaagggatactagatatttacccaatgagacaaacttcactgcttagccaaaatctctgagacaagtttacgtcatcttagttaatccttccctgagtatcccaaatggtgcactctatttctattccatatcctattatgttttatcccattaaatgaatgaatataatgtatgttgcattacagccatgttttgtggccttttagtacttataacctatcaatgccatacattttttgtacttactgaaaaaatattaaatctacgactataatggaatacaatattgcacatgctttttaaaaacatccacacatatctatttctacttgctacatattctgttatacatattttgttttatatcttttgtctaactttagaatccctgctagacttacacacatgttcatgcacacatgcacacacaagcatttccaaatacattttggtcccccgagggacaccttattcatgcatgtttagcaaatggctaaaaatgagtcttatatacaaggcaagcaataaatatctgttcaatgaataaatgacagaaataatagataagtatatattccttgtcacatgactcttcccgttttatcaagggacagagagatgattcataataaaggcattttcagaagactcaaggaaccaaccaatgaaccaatataaagttatttcattgaacccatttgttagtgagtcagcattctttcctcgctttggttttctttatagccaattaagatctttgcaaaatagtttacatactttcttcttagacaaatatctggctgtattcatctagaatttgcaatattatctattttgcaaactaaaatcctagccgaaactgatgttgacatcctattgcaatgtggttctaccagatattttttttcccctgagacagtctcactctgtcacccaggctggagtgcagtagtatgatctcggctcactgcaacctccatctcccgggttcacaccattctcctgcctcagcctcccgagtacctgtgactacaggtgcctgccaccacaactggctaatttttgtacttttagtagagacagggtttcaccatattcgccaggctggtctcgaactcctgagcttgtgatctgcccaccttggcctcccaaagtgctgggattacaggcgtgagccaccgtgcccaggccagattatttataaatagtaaatgttgtacaattaataagcttgctacatatctgttattcaggtgactaggtgtagtgtaaacaattagcaggtaaagaaaaggtacctgatgtcacaagacttgtaactaaaaaagtctaggtgagtctgaagaaaagggggaaaggaaaatattaggctaaatgtaagttgtagtacattagttgagtgattaaaatcaaacatctgttatgaacaacacaagtgaagccagtaagagagttgctatacatttagtggttttcaagcttagctattttaaaaagagctgatattcaggctgcatcctagaaaaactatcagatactcaggatgtgacccaggtctttgtattcttcttgaatttcccagatgattccaagatttagagaacaaaggttgcacctcactgctatgattgaaactgacctacatgaaaaacacatgactggaaaaaagcctatggtggcagcagtagcatattagaatagctttggtatcattcctcaggaggttgaaatatctcttatggcccatacatgggttatgacaggagctaagttttaaaatcacattaatcaattgtaaactctttagagtgtatttattgggtttagggtgaaaacaagtatcagatttggtatgtatagaaggaaagcatgggagctgaattaaatactgcaaacggcataagaaccaccttcatttcatggtgggagggtggaacttttcttccagatagccaggtacaagagaaaacacagcagatgtactttgcattgaataaagactacacatcctccttaatcaccacctttcctttttatggagtaagtgtgaattattgtcagtttcatcatttgtaatcagtggctgaaacagatgctgaaggtttagtttaaaatgatatgtgtctcttataacaatttgcaatatgctctccaaggactatttaccttccacattgcagaaactcactgcaaaggagtttattcttaaaagcatttgaggtaaattaagcacaatgaatgcaactttcgttagagataacatttagcagagttattatagggcttactatgtctgcagtgagtgggcatttgccttaatgactttgtttaacaagctttcaattccttgcttatgtgatttaaatgctcttataactatttgcccttaggagtttggtaccaacacaaggcaatcacaatttgtttttttgttatttttaaaccaagttagtatgtaagagaaatatatttatagttctgatatcaagggtaatgacaaaattcttaagtttgttgtgcatgttacactaggcattagcatcatatatttataatataaaatatatccatccacacacacaagttgctcatttcatacacagagctagctgagtgtatacaatgaatagaaaagtatatcaacttcattttctagatgaatcacagaaaagcacatattttgaaaatgaaatactgcaggtaccttgaagaaagtcagaaccaaaatcaaggtaggacataaaagtttttgttctgatctataacactttggattttttcaaaaataatatgttcatttactatttgtgtaactaaaaatgagctatataacaatgactaaaaggaaataacataaaaagagaaatgccatagaaaacttagaaactgtaaatgaccaaagtatagtccttaataatgtgagaatatgagaaccaagctaattttaagaattaatcattaagacgcagaatttaacaaaacaaaaaaaaattttaaaagattagttttattatcaaaatggcacaaaaactaaattcttctgcaatttcaattccaataccaattttaaaaatttaagtttatgtttttgtgtagtggagtgagtatctgccagttaatctatgacacttcatgatatttcatgaacacttcaatagtcctctaaacagaatcagccctttgtccttggggttttccacaagatagggtagatttttcccttaaaattgatatacacagcccagaatattggtggaatgtttaattcctcaagttctaaatatactttttaggccatcagccatataaggtgtatatattcctccttccctttgtcttgataaaactgacggacttcagattatcaagcaaagagatcactttattatattgtatcaggattattcttcaaatgacattaccaaatgtatcccattattaaagaaaatgggtgctttgtttgatttaataaagcaacatttactgaagagaggtcatagtagacttacaaaaagtatggggtggtatggactgaattacttccccccaaaatttatgtttgaaactctaattttcaaagtgactataatctgaggtaaggcctgtgggtggtaatttaggttaaatgaggttgtaaatagggtcctaattcgaaggagtggtgactttatgagaagcagaaagaagggagagatgtctttctcctttaacacatgaagaagtcctgtgagcacacagtgagtaggctgccacctacaaacgatgagaagagacctcagaatgaaatttactttctggaatcttaatcttggacttctagccttcagaactatgagaaataaatgtctgttgttggacccatccaccctatggtattttgttatgaccgccctgagcagtctaaaatgtgggtgttctactcttttctgccactgggaaaaggacatatcagatttttgccaataacttacttctcccatgtggtgggttgagaggtagttcccaaagagatacgtccatagcctatcctcagacttgtaaatattaacttatacggcaaaagattgactattatcttacatggtaacagatgtgattcagttaagaattttgagatgaggggattatctaagatttttctggtcaggccttaaatgccattataagtgtccttgttagaaaaggcaaggtagataacatcgaagaggaggtggcagtgtggccagggaggcagagactggagtgatacagctacaagttaacaaacactgacagccaccagaatctagaagaggcgaagaactatcttagagcctcccaaagaggtgtggctctataaacactttaattttgtgcttctggcttctaaaaatgtaaaatttctattttaagccattcaatttgtggtaattttttatagcagccagaggaaactagtacaccccatttcagtttgctcatccattttcagtggatccacagtctctctacacatctcatatttctttataaaacatttaaaactcctaagttaaaccatgtgtgtgtgcatgtgtatacaagtaagtcttgagacatttgggaagtctctgttaactttgtcaacttcatttaaaaatcagttcctcatattctaaggatgtattgttagatatattcccattaaaaacaagaataaggcaaggattctggcttaacccttatctataacattattttaaaattcttctgaattatatgaaaatacaataaggctcaaaaataagggatttacctattaaacaagaggagaaaaataattatgagcaaatgacatgagtttccacttggaagttaaatagaacttaccagaaactgttaatatgtgagtacaaaaaagaaagcaattaagagtggcttaaacatagtgacagctttatgtcagctgtactcaactaaagttaagatgtcataataaaatcttggtaaaaatataaattatttaaaatttaattattataagaactataaggggctggctgtagtggctcatgcctgtaatcccagcactttgggaagccggggcaggcagatcacttgggcccaggagtttgacaccagcctgggaaacattggcaaaaccctgccactacaaaaaatagaaaaattagttggccgtggtagcatgtgcctgcagtccaagttacttgggaggctgaggtgggaggatcacttgagcctgagaggtcaaggctacagtgagctgtgatcacaccactgctctccagattgggcaacagagtgagaatttgtctcaaaaacaaaccaaaacaaaaaaactataaaacacataaaaacaaaaattaaattcctatggaatacatgtagaaaaaggcatgctatatttcttgatggcaaaattatttttaaagcaataagtatctgccaaattaatagtttggcttaatgtaattgtaatcaaattgtacaatgttaattgtaatcaaataaatcttagctagatttatttagactttaactcaagatttgtttgaaagaataaataagccagaaaggctaagaaaaaaagactaatatcataaagatacaatttttttaagtcaaaattttctaatactgccaaacaaaatcaacagatcaatgaaacaaaatagatagccctatcagtcatagtaattttatgttaaggggacacatcaacaattattagtgaatgggagggctattcatcaaatgattgggaacattagatgattattttgaaaactataaagtttaatttttagcatataacaaaattctggatacactgaaaagttaataacaaagataaaattttaaaatactatttataatttatatgaacattcttctgagctctgaattgaggacttctcaaacatacaatatttagttttaaaaaatccataataaaaacattttatattttactacataaaaatcataatcataaaaatctaacattcgtattcataaaaacattgatgaacaaaatgaaaagtcaacctcaagagaatatacactataaacatgatggatatagtttttatcattaattacataatagagatgttatttttgtctgtgttaatttctatttcccgttgctgtcacgtcacctaaatattcaaccatgaatcttgaagtcccgggggtggaagggaaatgttctacacgggaaggatatgtacatcccttctggctcaaggcattgtggggatgaggaagaagattcaagcagagaaggaaagtagacttcaattattgatcaccatctcccaccctattctcatatcttttgagcttacattttgggaagctgattttaaaaacatccaagagttatggagtagactctctagagagtggcttgcctcactatatactcatagggggctagtaatgacaatattctagaagacatatatgtggtatccatcatggtactggagtgatggcttagaggtgtcatttgatgctgagatagactctcaggaagtgcccctggtcccaccagtctctgtatgtcaagcaagggacccagaggtgccagtgtgcctattgagagggcagagtggtgcttgaatctaggtgaagtgaccatggcgggcaaggatgtagaaaccagtggcaaatggccagaattgaggactccagtgaagggtgccagcatgtcaagcttaaattgctaaaggggactcaatcatagtgagaagtcacccgtcctgggaatcaatagcccagctactccgcagtgaagacaagaggatcctgagaggtcaggtcaatctgaggaccccagcctctccagtgctctatgatcataggaaatggagatggtagagagcacagaaaggaaaatggcctgtgaggatcagaggatttgcaggttaaataaggggcttgcaatctcttcttataccgtaacatgagcaaatttctggcctaactccaggtgttgcctatctgtatatttctaaaaactgaagcattctcctggaaagtgaatcactgagggtgtggagtccgggatagaccctttaggattatgttctcacttcttttctcatctatcccttcttttttacatatctcttgttcaagaagcaaagacctttccattctgtttgccgtatcttcttgtgctatggccataagcctcttggattcgttctcttttcagaggggagattctctccaaagtctattaaataaacactttttctacatcctccaggtatacctctctaactgggagctgtggtatgacatggaagtagaaacctctgaggatgaaaattatttgctattctatcttctaaatattctctagtagaaagtcttaaatagctcacgcaactgataagaaaattcagaaaagactgaataagaaattcacaacagaaaaaaataaacatattaaataacatttaagttcacaagtaatcaaggatacatatttaaaaacacaaagccttattaaattggcaattaaaagagttcccaatgttggagagagtgctctaaaagaggatttttttttttatcatgctgctggtaatgtaaattttgctttaagctttcataaagtaatttggctatatgtttttgtattcttcagatgatcttcttagatcatgtgcttcttatgattagaaaagacaataaataatggctttaaacaaagctaagtatctctccttggcattcatcactgctgactgtagtagcctatgtggcgttggtgagacgtccacctggcatatcctatagcgcttatctacattcaccagacatgtatatcagtaactgttggcaggcagccaaagtgacagggatgttgtgctaggagttttaagtagctttaattttctgtttcaactgaaattctatgtagactttttcaaacgtatgtaattattcaaacataaatcaaagcactaaattaaaatacaaatagtaaaattatttttcaaagaaaagttagcacatgaatggttaaatccttttcttaagagatatagcaatgtgttgcacatatacaagttcatgaagcaaatttagtacaagaacctaataataacagtgacataaaactgtatcaaaatgaagatgaaatcccagattaaggtggcaaatgttcagctgaatcactgtctcctctgacaggtgacttcctagggactgcattaacactcagaaaagcaagcaactgtcccttcaattccatggtggtgttttcactaggaaattggtacaaagttaccatcatacacacaaagaataaaggattcagaaagactgaaagccagaaaaagtagtatcttcctaccttttaacttttcctggaaaaattacatatataatccttaaccctaaccctactttagttctatatatatagagagaaacatatatgtatatatatattttttttccttggctcttttaaaaaggtgatagaaggagccctaaaaaaagaagtgtatgtttatctgctttgtaaaatgtgattaagagaactattttccaaagctggattcctctaagctaaatgaaaaactattctttcctctcagttctatgtttttctaaaacacattaaaatctttggttctgtagtgtaggattttactgaagtagagtgagactggaaaaaaatattgttttccaacttaagaaatattcacagtgaatcctttaggcacaggagtagcagtgcagaatatcagagatcatgtcaacacctttatttcacaggtgagagctcagaggctctgaaagcacaagacagtctttggaggtcatgctgttagtctgtgccaagacaagatcttgctcctctgactgtagctcattcaattgcatcatcagtctggtgatatttactatgtagcaaggacaatgtctttccctcaattttccagatcaccaagcaatgatgtgcctgttacacatgacattaaatttaagatgggtctaatgaaggggaagtttaaagtgcatgaatagtgtttcaggcccatatactcctctcccggtgtctccatttctctttcctgtctaaggccaatgaattgccacagtatctattacttgaagaatctgatgccatttgctactttataacttacataagcttcttgtgtaattttatggaatgagattttggatgataaaacatttcaaatgaatgcaaacctttgtgacgttttctcagcacatatcacttaatatctattatcgtatgagataatacatgtaaaagggcttaattcagacaatacatgtaaagagcttaactcagtgcctggagaacagatataaatccagctgatcacatgtcaatgattttactttataactctgattcttctcctagtagtcatggccttgagactcttccatatattataacccaggccaggagttcttttaaaacttcaggagagcggggagattggtttattttactactgatacatcccaaacacgtagaacagtatcaggcacagaatagactcaaagacataattcccaatgaatacatggatgagtgtaagtaggggaatgatacagtaatgtaagttgtgagccctgctctgagacttgaagcccaagctcacagcaaaagctgctgcccagattgacagagatggaacttattacatagatggaacttactgcaacaaggctgatcaagaaacagcttgtgaggaatgttttcttttacaatgttagggtaatgcaggaagatgataagtatcagtaaggatttctatgacattgcttccattacaggaattctttaattcctcctccaatctggaagacttgttgtatattttgggctgaaggttttttgttttgttctgtttttttgtttttatttcatggatactatttcaaaaactgaataacagtgtcttaaacccagtgacagacacatttgttatgggtatcttaacttgaaactcccacagacctcggacaatttttctattagccagcattctttttttcttttcttttctttttttttttttctttacatttagaggaagtatttaaggaatggagatactgtctttttaaaattgtatttaatttaacaatgtgaatcagattatttaaaaataaactttagtaagtaatagttccagatctttaccttaaggtgatttaaaaagtaataactagatttgtcagaggtgtcagaacagagcaactccatcttgaacaggccgggtaaaatgaggatgagacctgctggtctcagcaggtctattcttagtcaaaagatgtttatggttaagagaacagaaacagacccaggacttaacagatccagaaaatgtcctgatgtcccaatatcttaagaacaaaaccattcctagattaagaataagtttcattttaaagataatacagactcttggaaaagatggtagttacacaaagattagcagtcctttatcacaaatccttgtagtagagcacatctcccccttgatttttgttatcttatatataagcaagcattgtacctaaggtgggcgcattcctcctcttactttcgggagcgccccactctgtctatggagtagccactctttcattcctttactttcttaataaacttgctttcactttactctgtgaagtcaccctgaattccttcttgtgtaaaatccagggactcacgtgctcaccaaaagtagtgttcagaaacatatattgaaattagaaatttcttctggtcgggcgcgttggctcacgcctgtaatcccagcactttgggaggccgaggcgggcggatcacgaagtcaagagatcgagaccatcctggcgaacacggtgaaaccccgtctctactaaaaatacaaaaaaaaaaaaaaaaaaaaaaatgagccgggcgtggtggcaggcgcctgtaatcccagctactcgggaggctgtggcaggagaatggcgtgagcccgcggggcagagcttgcagtgagccgagatcgcgccactgcactccagcctgggagactgcaagactccgtctcaaaaaaaaaaaaaaaaaaaaaatccaggaactctctcttaaggtctggattggggcccctttctggtaacagatttactaaatgattttgaaattaaataaaaacctcttataaactggtgttattaagaagatgcttcttttattttattttattttattttttgagatggagtttcgctcgacttttctcccaggctggagtgcaatggcatgatcttggctcactgcaacctctgcctcctgggttcaggcaattctcctacttcagtctcctgagtagctgggactacagggccactaagcccagctaatttttttttttttttttttttggatttttagtagagacggggtttcaccattttggccagtctggtcttgaactcctgacctcaggtgatccgcccgccccggcctcccaaagtgctgggattacaagcgtgagccactgcgcccgaccagaagaaatttctaatttcaatatatgtttctgaacactacttttggtgagcacgtgatctatgttatggattttaataaaagataatgttgtattcagcaatgctgcccaggaaaatataatgtgagctgcaaatgccattatgtcattttaaattttctactagacacattaagacaagatgaaattaattttcataatatattttatttaacccaaatattatttcagcatgtaattaatgtaacaacaattaatgagatattttactttttttgtactaagtcttcaaaatctcagtttgaacaagccacatttcaactgctcaaaagccacatgtggctggtgcctgtcattataaacagcacagttcaggaggttaaacagttttggaatcagacagttctgaatgtaaatccttgttcaacatttactaactatgagacactgaagaaatttaaacattccaagtactagttttagcaactaggaaatagggataatttataaattgaacattttagaaataatatatatgaaccatttactaccatgttaggaactcaggaactattacttcctgagtaaactaaggtttcagtgttcaaaacataatttctattaaaggtagctgctattagcaacatcagtgtaaacctttgaaacgtcagaaaaattctgttagtttaatgttcttcactgagtaaccaatattattaccttgacatgtggaaagaagctcatgattgtggaacatctgaaaggtgacctctttagcacacaataagataatatttttgtcacatagtgttaaatgtgcattaatcatgaggcagctcaccttcctcataaatcacacatgaaaaatgacaggtgatattctcattttagtggtattatctttattaaaagccacataatgccttggtaataagaaaatttattctggaataaattaaaacatttctatgcactctgaaaattaatttccttttgtttcaattcatattcacaccccgatcattccagtctagatgtataagcttgacttattctggtcaccattaagaatatcctcaaggagaccaattttggttcctctggaagaataatataaatttagatttctgggaatggtgtgaacagaccctggagaataagatgctgaaggtttagttttacaacataatagaaaaaagaaaacttattttcttgtcatacctaagtaccagttgcctgggctacgtcacagaatggtaaagcagtcaataaaattaaatattgtatgatactttttatactttgcaaagtgttttaatgctaataatctcaatgagaaaaaatatagagatacacattaactgaattgtagtaaaacttgcttgtttgggctgcagtaggcagatagatgaataaacagcggagaagtttctatgagcatgtaaaggaaaatgacagattttagaaaggtttatgattgttacgcagtgataattcagaggaaaataggttttaaaaatgatttttgtcagattcagccaaaggaaattaaaagtcaacaaactgggtattaaaatggagatctctttgatatactgatttccttacacaatggagtactactcaaccataaaaaagaatgagatttgtcatttgtaacaacatggatggaactgggggtcattatgcttagtgaaataagccaggtacagaaagataaacatcatgttttctcacttatttgtgggatctaaaaatcaaaacaacagagctcatggagatggagtagaattgtggttaccagaggctgttaagagtggtgaaggggtgggagaagtagggatgggttactgagtacaaaaaaaaaaatagaaagaatgaataagacctagtatttgataacacaacagggtgactatagtcgataatattttattatacattttattattattattattatttgagacagagtctcactctgtcatccagcctggagtgcagtggcacgatcttggctcactgtaacctccacctcctgggtttaggcagttctccctgcctcagcctcctgagtagctgggattacaggggcctgccaacatacccaggtaatttttgtattttttagtggagacagggtttcaccatattggccaggctgaccttgaactcctgacctcaggtgatctgcccgcctcggcctcctaaagtactgggattacaggcgtgagccactgcacccaaccaattttattatacatttaaaaataactgaaatagtataattggattgtttgtaacataaatgataaatgcttgaggggatggataccctattttacatggtgtgattattacagatattacagaccttgaatatctgtatcaaagcatctcatacaccccataaatgtacccacaaaaattaaaataaaacttttaaagggagacatacattttgaatgctgcactgaaacttaatcttaggaactttctctttaacaggatgagaaattattatagagtcagagaattagttcaaaccctggacttcaaatcccatcttacttcatagatgaggactagagaaattgagtgacttatccataaacaaagtgatagctaggggcagagggactggaatccaagtaatcatgtgatatttaatccaagacttcttttatggcagaaagttacttctaaggaaactgatccacaggctggggagggatatagatgaatatagcaagtggaatatttcctgacattttattccctttggctgaatgtgttcacacatgatgaagtaaagaaaataattaaattatatgttattatgtactagagagctccaaagtgagccataaaaatgatggatattttggtggggaagatgtgtgatttattcaaataattatttaaattctgtgctttattttgactagagaatgcattgtaatattttcagtttgactgtcatttttaattgttttgttattcatggatcatgggcagaggaagaaaagttgtcactactgaagcatttctagggatttcttctgggcaattaagcaaccacttccccctcatgaattgctgcagagtcacaatgcctaggaaattgatcagatgaacgctggttaagaaaataaccagctggcattttgaatgtcggatagggaatatgactctctattattactacttcattttggggattcgcagatatatgagtgccttgtaaaaggaatttcagaagtgagttttcacaccttgccttgagatgaaggattcttcttggttctactccagggaccttgatgttcctgttgccccactccctgtggtcccactgtgcttcctgtacccaggaatcagcccaaggtacagggagtttatttttctgaagtaaatgacaagtgaatgtagaaaagtttcagtagagtaattttgaaacaaaagtaaaaatgcatatatgcccaaaagtacaaaaaaagaaaagctgtagagaaaactgttatttaattctcaaaactgatagaaagcaatgaaagattttggtggtaacttttgattctgctgatagcacaatcaaggaagatattggtaattgaagtgatataaatgtctataagacaagcagcattgttcatcttcagcagaacaagtaatgaaatggaaatgttttggggttcataagaaattacttcataattttcctaagagaaacagcactcaccaaatgttcttttcttgtgaataaggcattgccgctatcagcaaccatttcttttattattcttgagaatatttctgatcctatattctctgttatatacttcatcttcaacaatgtttttaaaatcccttctaaactctccttttgattagtagagttagttttggtcaaaattaaatctaatttgtcaacatctctttgtggcaatcttttgccttattaaacttcaagactgggttactaagtcttcttgttgatttagcccttcccgggattctgagacttcttgcctgcaaagaaaaaggaaatactagaatatcagtcaagagctctttgtcctactgcatttgggctgcagtaacaaaattctgtagagtgggtaatttatttaaaaaatggaatttattacttagagttctagaggctagaaagtctaaaatcaaagtgctggaagatttggtgtctgataaggacccactttctgtttcttagatagcaccttgttgctgcatccccacatgtgaagggacaaagaagctcccttcaacttcttttataagagcagaaattccatccataagggtgaaactcttatgatttaatcacttccaaaaggtcccacctcttaataccatcaaattgagtattaggttccaacatgaattttggaatgataccaacattcagaccatagcattcattaaagtcattaccaagcctgtctcattattttcccaattctagttactgagtgtgtcaaagactggctaactgcttgtcaaatgcattttcttctttgagagaacacacctagaccacagctcccattatccatggcatggccaagtttcatttcccagttagtttcagccataccacttagatctggtcagtggagtgtgattgaagagatgggtgtgtcactttcatccctggcccatgaaaatctctttcttgtgactccttcatttaatttcccctctcttggctgctgtgtgcagatgggcatgacaaccttgaaacccccatgataaacctgacactattttaagatgtaaagactgcagtttcgtaattactgcttgaaggtgagacattcatcaatcagaaacactcattttcaacctgagtgaaaaataaagttttttttaaaaaataaaaaaccactaatatttggtactttatctattacagtggctatcattactttatataatactgtgaaatacacactcctgcaatacattccaatcctagtaacttagtccctgccctgtttctgtttactgcacctacatttcaattgctctgtagggctctgcctttcctcttagtccttccagaaattaagctttgctctgaaaacctattcacatgccaatgtattggatagaccttctggtgttaggaccaggcaagaactaggtgctctcttcttcctcaaacacaggcttcagctagtctttagagaactgctgtacactctgccctccagattgctttttccatgttcttgactctagagtcagtatgcccagctttggttatggccatgtaagcattttacatttttaaggttttcctgctgtaggagaaatagattctatgttgtgctttaaaattagactggcaaaattatttattttaactaaaaaaaataagatatacaaggaagaaagtcaacatgaaaataaaaacctacatctttttaagatgatgagtacattgtgatacgtttaatgaaataataatcaccatttgattatcctggataagcttcatggtacaggggaacagaagagaacttgtgggcaggtttgcttccaaaaggaacaaagataagtttgtttttcccaaattacttgtctggtaagtcactaacctcagccagggtggagtcagtaaaaaggcaaagagaaaccagcagttacactaatccactccgtccacatggcaggacatactaggagggcagaaaaagagtttccctctgacagaaaaagttttgaaaaattggttatgaatgagcatagatatcactgaaacttttgagataaaaatatgtaaatattttctaatggtctccattttatttttaatcagataaagcctaattcaatgttttacactctcaaactaacttgtgaccattttctcacttaagttttctcattaaatgcctttgaaacttgtgcctgtggtttcatttataattttgtccagtggaaaccccaatatctggggcttacatttttaaaattttttttccagcttcattgacatagaattgacaaacaaaaattgtaggccaggtgcggtggctcatgcctgtaatcccagcattttgggaggctgaggcaggtggatcacctgaagtcaggagttcaagaccagcctgaccaacatgatgaaaccctgtctctactaaaaaaagtacaaaaattagccaggcgtgctggcatgtgcctgtaattccagctacccaggaggctgaagtaggagaattgcttgaacccaggaggcggaggttgcagtgagccgatatcacgccattgcactccagcctgggcaacaagactgagagtctgtctcaaaaaaaaaatagtatatatttacagtatacaacataatattttgatacacaaatacgttgtgaagtgattaccacaatcaagctaattaacatatccatcacctcacatagttaacattgtgtgcctgtgtctgtggtgagaacacttaagatctgctctcttagcaaatttcaagtctacaacacaatattattaactgtatattattattaattatactccatactatacattacctctccataacttacatcctgaataactgagactttgtattctttgaaccacatctcccctttggctccatccctatcccctggcaatcaccattctattctctgcttttaggagtaacgttttaagattccctgtaaaaacgaggcaatgaagtatttgcctttctgtgcctgaattatttcacttagcataatgtcctccaagtttatccatgttgttgaaaatgtcaggatttccttctttttaaaggctgaatagtattccattgcatatatatacgccctattttctttcttcatctgttgatagataccgaagtagtttgcgtattttggctattgtgaatagtggaatgcacatgggcgtgcagatatctcttcaagataatgactttattttctttgaatatactccagaagcagtgtttctagtcaatatggtggccatatttttaattttttgaggatcttccatgttgtttttaataatagctgtactagtttacatttctaccaatagtatgtgtgagcattcccttttcttcacatcacgatgtttatttattcattgctaattactacatgcaagcagagtataacaaatgtcaataataagctataaacttctgaatattctaaagttcttaccatctgagatcagttttataactcccttatgcttaatcttcattacataaacacaacttcaaaaagttcaagggagtagagaaaatggaagaattcaagggtccatttaggttagaacacagaatcagtgaatccaccttagtgttgctataatgagttgaagataagaaagaaagaacaattttgattggaaaatgggattttcctaaggctaataagaatgtaaaatatatgtggtcattagaaatgcaggagtagagatgctttactaggaccacttaagaattgatacttgttgtatagttagttaatccttatattgtaagctaaaaacattacacaaaaataagaattttgtgtcatcaaccattgatctgaatacaagttatacattacccaacaataaatacacagagtctttatggagggagaaagataatgataagagttatttcaatgatatctatagcctatgaagatgggatcaggacaagttccatatgcccataattagtatgcatttaaatggaagatgctttcttcattttcaaacccttaatatgacaattttgcccttgattttcatcagcatcacagatttgatcagctctttatgttaacaatcaaatctcttccaaggtgtaggtttgtttaacacactgtaggtttatttaacttcccatagctgtattttactcaacaatatagttatatttcatcacaaaaatgacgctctgatagttctctgactcttttatggccaacaggaaatgtaacattactgaaagggtttatagttagaaaaaaatagctaagggccaactactttctttttttttttttttttttgagacgcagtctcgctctgtcgcccaggctggagggcagtggcgcgatctcggcttactgcaagctccgcctcctgggttcaggccattctgcctcagcctcccaagtagctgggactacaggcgcccaccaccacgcccggctgatttttttgtatttttagtagagacagggtttcaccgtgttacccaggatggtctcaatctcttgaccttgtgatctgctcgcctccacctcccaaagtgctgggattacaggcgtgagccaccgcgcccagccaactattttcagcttgagtatcacttttactgctcctgggccaaacataaaaactgatcagtgaagggtccgtcaacagtatttaaaaaagaaaaaatactgaactgtgatggctgtgtagctctgagattcagtcattattcaggataaccttctagatgttcagaccaccacagataatatggtgatacatcttaaaagtggcgagatggccagagcaaactactgccacgtgttaaagccagggaatagtaagctcggtctttgggcaatgaatcctggagaagacacagagttattgtggaaaaaatcggcaaattttggagtgcattaaacattttctgtgtgctaaataattagaatgagacacgtgtgcgtttgctttcaaaagaatgcgtatcttagattaatcaatacatttgtacttttttttctttttttttcttttttttttgagacggagtctcgctctgttgcccaggctggagtgcagtggcgccatcttggctcactgcaacctctgcctcctgagtagctgggactacaggtgcccgccaccacgcccagctaattttttgtatttttgtagagacggggtttcactgtgttagccaggatggtctccatctcctgacctcgtgatccacccgcctcggcctcccaaagtgctgggattacaggcgtgagccaccacccgcccggccacatttgtacttttttacagctattacaacttataatacattttgacattatgcttttctacaatcaagcaattctacaatccagctgctacacatgagactctgcaactgtttcatgtgaaaaaggaaaatggagtctccattctcaaaggtaattattttttttcctaacttttagcatgctgttcatcactaattctttcacatgcattgaacaggttaacactcgatataacaaaagcatatttttctcgggaggtggtggcttagaaagcaccattaaattgggtatgaaagccctaatgtgaaaaagaaattccctttataattccaggccaactgtgaaccaacctgtgtgattttgcttgagtctgcaggaagtaggtgtgtctgtttaggacaacctccagctagagaaaaactgcattaaagccctccaaagatcctcaagtggtgattctccatcctggctgcatgtttgaatcaccttaggagtgtttaaaccactggatgctctggctgcacgctaggtgaattaaatcaaaagctcggggtagattcagaattcataatccttataacttccaggtgatttcaatgtgttcccaaggctgatgttggcatttctgagggccttacagaaattgggatggcacattacattacattgtgcaggtgcctgatatggctctcaaactgaaaacaagttaaaaaaacgtcacatctgtagccagttactcagttatctagtctctcaggggacatgttaacagcatttattgatttggcaagataaattgttatggcccctggggaaatattaagcacatctcagcctcactatatttccataatcattttgcctaggcttaatttcaaacatatttcccttattttaccctaaatcagcctggtctaaatctgcttttgcatggaatatggtcttatttttaggctttttataataaccttattgaactattgcatgatcactgtgtgcaattacctcattgcatctatctgggtgtgttgtttttctcccttattttttgcaattatttcaatggagtataattcaattacctggaaacaggtttttttcaagtagaatcttaatatcaataagtatttaagttctcactgtatgccaggcatgctgttatgtgcacatgataacaaacttgaattaacccatgagtgttcctctcaatggggccacacagtcatgaaagtgaccaaagagtaaaataaataagccccaaaattcattgaaataagttgtcattagtcttataaagacattctatgaaaagaaaagagtaacatggataggagacaggacacaagggatggtgacaactgaacttggtcatttcaaccctgtaacttttttctgattaataaatatacataaaaaagtggaaatatagaaatatgtaaagaagataagtaaaatatcactagtaatcccacaatctaaacaaagcagacctgccccatcctgccccatatgtatgtatacgtatatcaaatatatgaatgtgtgtgccgatctaagtaaccagagagagaatctttaaaagaaaagatatttgtttgggaataaagattgtagtgggaatatgcatgccatagaaatctagatatgtattcagggaggtaaagaaagacaaagcctttaaaagaatgaagaggattatatggttgttttgatataattaattatcaaagatcaataacaagagtgaccagcctgaggtggacagcgagttgctgggcagatgtccttgcagaaatatttttttgtgcaaggttgtgatggactttgtgtaagttgtgtgtttgtagtcttttgtgttaggctttgttatcaggcatacaagcataaaaaccctcttttcatggccttcccaggcattattggtctgatttttttaaaagcatttgtgacactattttgattttgacaatttcacatatatgtgtgagtgtacgtgcatatttattatatgcaatatgtgagatacagcatatataaatgatatatacaagtatacatatattacacattgatatatatacacatatgtgtatatatactatgtttaaacacatttgtgtatatatataatatgctcatttatttacatatgtacatttataacaatacattatacatacaccatagcaatacctgagaggaactaaataatgatacctctctttcctgcccagggtcttaatcaattgagaaataaatgacagaaactgaacgctataagccaggcatggtggctcacacctataatctcagcactttcagaggacgaggtaataggattgcttgaacccaggtgttcaaggccagcctgaggaacatgtcaagaccttgtctctgaaaaaaaaaaaaaattagctgggtgtggtatgtgcctgtagtccaagctactcaggaggctgaggcaggaggatgctttgagcccaggagatcaaggttacagtgagctatgatcatgccactatactctagcctgggtgacagagtgagaccctgtctcaaaaaaagaaaaaagaaataaagtgaaggctctaacaacgtctttattgttgataaacacagttgaagaatatagctttgtgtgagaaaccaaagagtcacctaactgaatccagaattagaattatgcagatgtatccatccagccacaagcaaatctggccctggggagatcaagctccaatagaaaatgtactgcccctggagaaacagtgtggaactcaagccttctgtgagtaggctgcttcccaaagaagagaaaggtagaggccgagatgagcatgccaagtttagtctatacaaatttacatatggatgtaattattttgtaatatatgtataattatactacatatattatcatattaatattaacataattatgtaattctaaataaatattatgctgtggtgagtcaacctagtaaaaaataaattctcaagaaattagttattttaattttcaaaccaaattattaggatataagacaaagcttaacctttagacaaatgtccatggtaacaattctgctccccaaaaccagtgtgtagtgttgtcaaagcccatctcattggtgtctgaggaacaaaggcagatggtagacggtgaaaatctgaacttcaacttacctggtttatcagccagcctatttacatttctggaatcgaccacctgtgaacttaattgataggagcctcctagcaaatgataaatgttttcaccatgaatttgccatgtgtggggtggggagggggctgggaatccagttgcctcctccctgtctcctccaccagactctctcctccatcacagggcaatgttcagacaatgctgtcatctttatttgtagtggcagcagactttaccaggggttataagaaaattttttttctttgccaacctatgctaaccttcttaacttccatttcctttggagcattgcagtcccaaggatgagctgtgagtagcactgatcccaaggcattctttgagcctgtgtacattggtactcttcttttgcctgttgaaagggaattgatttggcctaaaaaagtcctgtctcctagaaaaggatctcactttagagccacatttgtttcaactgctactgaggctgttgaggctggcgctcccagtaagggccagtgctttggtcaggtggccctctgaagtttagacaattaactttcttttctgtttcataaatttcttgggcacagtgaaacccatgtgcctagctacagtaactatcattttgaaactcattacaatgttctttagtattttcttttctctctctctttttttttttttgagatggagtctcactctgttgcccaggctggagttcaatggtgcaatctcagctcactgcaaccgctgctgcccgggttcaagcaattcccctgcctcagccttctgagtagctggaattacagatgtctgccacagtgcctgactaatggggttttaccatgtctgccaggctggtcttgaactcctgaccttgtgatccacccgccttggcctcccaaagtgctgcgattacgggtgtgagccaccgcgcccagccagctttagtattttctattacagtattgaacctttagaccaaaaataattggcccagatgcatcatttaaggtcaagtgctccacagttccaacctgtgctcttaattcagaatggagtgctacctactgccacctgaggcaagacaacatagaaactacctagtgttctgttgctcagatgtaacattgcactcttgctttgtacaggcaggtaatgatcccactttagcctaggcagtgataccaggccaagctgtgcctacatcctaataaactatagccgtctgcttgccgcctgaggccttagcacctgacaaagaaactgccttggctgaggcccttgccttgcactgcaaattcaaggtcaaactgcaacaatctgcactctgaagccatctgtgctggccatgcctttggccctacctctacagaaagtcatctggggtcagaaccacaatacattgcagccactggacaaagtcaaaaatacctagtgacctagtaatacctagtaatgcttaaggactcttagctaggtcttagcaaatgaaagctaactgtggaaagtaaaaacctttctggcctagtgtaatcttcacaaaccacccatgtcaacattttctgctccaatactaaggttgctaaagaccaaagctgcttcagaagttttgttcattccacatgcaatttgctttctgaatttttcttctctcccagtgttcttagtcattgtaccaaagatgaggtctaaacacacacacacacaccgcaaacatacacacatatttatgttcttctttcacatgtaccttttcatgacccttttcatcctccaatctggctatccagaagcaaacatttttaactcttttagctgattatttttggttttctttccagagccctaagttatatcttgtattgtcatttttttgattattcaattttagaaatacttattctttcatctcttattcgaccaatttcctagtacaatcaaatgcctgctttaattacattaacaaactatgtaaatgtaatttacttgaaagccaaatatcttatgcttgtgcagctttttcatttaccaaaagtttttaattttttctttttacccattgtatctctttattccaatattatatttaaactgttcatcttttcaggtattgtataaaactttctttctttttttcttcttccactggtcatctggacaagttcctttttaggtttgcttcaaggtggttatccagaagttcttgttcgttaggctatgtttcctggaactcaagtctttgtttttcttggtttacacactcattttgctagagcaaagagtatgtgagaagtgatatttctgaaaacttgtatgtctgaaaatgtgtttagtttagtacaaatgtttagcaaaaatgtttagtacaaacatttgaatgacagtttcgtgtgacatggaattttagtcaaaatatatttcacgcttctgaaatctttgctctatgactatggagtatccaatgttgttgatgagaagactggcgccagtctgatcatacctctgtagatgatgtatctgtctctctcaaaactattaggaccttgtctttattcctttggttctaaagttatagtctaggagtgggactttttcatttatttatttggcacatagaaatgcttttgatctggagacttatgttctgcaactccagcaaattctctcgaatgattctttgatattttacaacctctctttcctatgccctctcattacaaattgctatttactacattaatatttattactccctatccaataacgattttaaaactgaggtataggtacttgctctggattcacaatcatcttgagtttaatctagatacactctcaacaagtccataagagtcaaatcttccagcctcccctgaggctagaggaaaggtcatagaacaagcagctgaacttctctcagaactaactcatttagagacccaccttcttatttagtaggtgtagctacccgaataatttaggtaaaatttccaaggttttaccaccagttagtggcagagcctggattagaattaaaggattctcatatcttagtcaatgttccttttccattacataatgtttttcttgtctgcaatagcccagtgacttgaaacacaaattcacagatcctaagaacaaacctaatgggtgtggcttctaaaaattattccatggacttttatgaaaacaaacaaacaaaaagtggagaagggctgtggagatggtagaaactgcagacatcttccaggaaagggcattttaagattccctcctgccatacaatcacggcgacaacttctactgcaattgctcataaagccatttgctaagatacagtggttgttatatattttaaatatttactttaaatctaacattgcttccttgggaaattgttattaaagatttgtttaaattatataaaacattaaacacatatagaaaatatttttactagattacggttcttagactaagtgttaagactgcattctagctaccatacccaataggtatgctactatagagaagttggttaaattctgagagtttcttcatcagtaaaatgtgaaaataatcacaatgttattctaaacattggatgaattatgcatacatagtatcagcccagtggctgatacttggaatgtgcttatgaaaatatgttaaaccagtgaatgttagtttaccaagcagggcatatgaactatatataagattcctcatgcatataattgtttgacaaatatgtccattaaatgtgaaaaaatctggagaactttatggaatttgaatagtattatctcagttgacttacttataagcaagtaaaaaagaagctgtgaatgatttatataaactgagagaatagttcaaggacacgtgtcatttctgatgctgttattttgtattaggctagagggatgtcttccctgaataaaaataatagttttttttttttacaaatcaaatatacaaaagattatgaaatatacatatactcaaaatatactgtaataattgatcatcggtaataataaatgtttaaatgcataatatagataatgctcaatatattcatttattcaattgattagtcatttatttgttcattttttcatcgtatatttattgaattccaaatcaatattactgaggctttgaagagaaagtcactgcccactggggcagtcttatctctatcacctaattcatttgaaacaaatagaaaacagtacaggaaattagaacagatgtaggtgaatgtcctttgctatttttacctacaacatgtctcacttcagactacccacttttcaagtgcttaacaggcatatgtggctagtagctactataatagacagcacagatataaagtcatagtacttactgcatcctaagtattttgtataatgcctagaacatatttataattttgctccaataaaaatgtataaaatgaatgaattaattaataatcaatttagtcaaaatagttgtatctgtcagtactatttagcactagttagcacttgttggttgcaagtgagaaaaatctgactcaaaattatttcattgaaaatgagtaattgggccaggcgcggtggctcatgcctgtaatcccagcactttgggaggccaaggcaggcggatcacaaggtcaggagttcaagaccagcctggccaatatggtgaaacactgtctctactaaaaatacaaaaagttagccaggcgtggtggtgggcgcctgtagtcccagctactcaggaggctgaggcaggagaattgcttgaacctaggaggtggaggttgcagtgagccgagatcatgccactgcactccagcctgggtgacagagtgagattccatctcaaaaaaaaagaaaagaaaagaaaaagaaaaggagtaattgaatcattcacataactgaaaagcctactggatccaaacacttgaaagaggctgataggcaatctcatctatcctgtatcccctgcccattacaaattccttgccatcttttggtttagctttacttagccaaccattattggctgggctgctgaccatgctacatgtcctacatgaattatagttacctggttaccccagtgagggaggctccctattgttgcattcttcaatcaacttggagagtattatgactcaccactggttcttaaacatctgcctgtaaatgataactataaccaatgctcacatttccttggccaagcaagtcatatggtcacacctcacctcaaagagtaggaccaagaaagacagtgttgccatttgccccgaatgctgcaaaagtggaaatgtagaatgaatagcctaatgacttccacacttactattagcttcattctctggcaaaaatccctgagagttaagttagttagttcctgattcatatccttccattttagtaatttccatagaaataagtattttttgcccagtggtttcaacaaaattcccctggttggatgaaagagaatttgagatgaactctaatagtttcctattatggctgtataaatgaccacaaacttgcttaaaataacacaaatttattatctggaggtcattagtttaaaatgggtatcactaggctaaaattaagatgtcagcagtgctgcattctttctggagggtctgggagagtatactgcattgaatgattatctccaaaatgatatattcgtaccctaaaccttggaacctgtgaatgtgaccttatttggataaagggcctctgcagcaaccaacatatgagagacgtgtctttatggcagaacaatttatattcctttgagtataaacccaataatggaatcgctgggttgatggatgtagtagttcattctcacactgctacagagaaatacctgaaactgggtaatttatagagaaaagaggtttaattggcttatggttttacaggtggtacaggaagcataatacctgctgcttctggggatgcctcgggaaacttacaatcaaggcagaaagcaatggggaagagataggcccatgttatatggccagagcaggaggaaaagggagaagatggatgtgccatacacttttaaacaattggatctcttgagaactctatcacaagaacagcactgaagggatggtgctaaaccattcatgaaggatccacccccatgattcagttacctcccaaaaggtcccacctccaacactggggattacagttgaacatgaggttcaggtgaggacacaaagctaaacaatatcaaatagtaattctattttaagttctttgagatagctccaaactgcttttcacaattgccaccagcagtgtataagtaatcccttttctctacaacctcactagcatcttttattttttgactttctaataaaagccatgttgactggtgtaagacggtatctcattgtggttttgatttgcatttctctgatgattagtgatgtgaagtgttttttcatgtttgttggtagcttgtatgtcttcttctgagaagtgtctcttcatgtttttgcccatttttaaaaattgggctatttgttttttgcttattcaactgtttaagttatttatagattctggatattagtcctttgttggatgaatagtttgtgaatattttcttccattttgtagattgtctgattatgatgttgatagtttcttttgttgtgcagaagtcctttagttcaattaggtcccagttgtcaatttttgtttttgttgcaattgcttttgaagacttaatcataaattcattcccaaggttgatgcccagaatggcatttcctaagttttcttctaggattttacaatttgaggtcttaacatttaaatccttaatatatcttaagttaattttggtaggtatccatcccctcaagcatttatcatttatgttacaaacaatccaattatactatttcagttatttttaaatgtataataaaattggttgggtgcagtggctcacgcctgtaatcccagtactttaggaggtcgaggcgggaagatcacctgaggtcaggagttcaagaccagcctggccaacacggtgaaaccctgtttctactaaaaatacagaaattagccgggcatggtggcaggtgactgtaatcccagctactcaggaggctgaggtgggagaatttcttggacccaggaggcagaggttgcagtgagccaagatcgtgccattgcaccctagcctgggtgacaagagcaaaactctgtctcaaaaataaataaataaataaataaataaataaataaataaataaaaataaaaaggctatcatttatcatattcattttaaatgaaagttaatttgggctgcactacataataggcaatagaaatatacagaaaaaaataaataactagaatggtagaatatggatttatggccagatatatttgaattaaaaatccagtttttgccatctgactgactatgaacaaatattgtaatctctctggccttaacttcacctcaaaattggggtgaatgtttgctttataagcatattgtgatatgatttacataatgtactttacacattgcctgaagcccattagggtctaatatttggtgatgtttatatttttgctattttcgcttatggctagatcatatatataaatgtaggagaaagggtaaaattaaagataattatctttatgtttagctttgacaaccaacagtatgatctcactaataatgcgtggaaatatagttttaataattggcttaatgggaaagagatgataagtttggtttgggccatactgaatttaatctacaagtaagagagtcatgtgaaaataatactcctgacaaataaaattctgtttttagaattttgagagccaagtaagagtcatgaaaccaagccattgattcaggaaggaaaatgatctagacacttgtagtaaaagttgcagcaaagtctggactaaaaggtcagtaagtcagagtattttatcttcttatgaatttcagtatccagctattatcctgctagagcaggaaatgaccccatcctgaggcttcctgaagaagggcaccaatgaatttgcttaactttgataatgacataggataaaaaggaagaaagtaaggcaggatggaagggaagggggcgaagtctgaaaattcaggagaatgcatcgaaataataacccaaagatcaagtaattatgtctcataacccagtgcctgctaaataatgagaaacgtgtatttgggataatatatcaaaattttaatcttataaaacaatatcaaaataaagagcatttagacagtaactatctggagaagtattgaaggacacaattatagtgttcttaatgttagaattagctgggttgcttaattttttttattgaaaatgatgtaacaaaaactcccagagatatacatttgctgaagagctttctgtgactacaaattgcctcctcctaattgttatggaaagtacattaaaataatagagtcaaggtataattaagaaatagcagaatctaggccaatacataagaccccagagctcaatattaaataaaatctctattgtttttcagagtgtgggggaccgtagagatgaaaacaggcaagaaaatacttggtttttctcattttcacttgataattattaagagtcatcaaacaagagtgaagaaataacttcatcagatgtaacaaaccagtgggctattctgaagacaggccaaagaagcagaatgaaagagagtcaaaggaatttattctcaatacatctctcataatccattaaaaaataagcaaagaaacttaccgaggccagcttggttgtggagaccctaacccagtggtgctagaggaattaaagacacacatacagaaatatggagtgtggaatgggaaatcagggggctgacagccttctgagctgagagccacaaacagatttgcccacgtatttactgacagcaagacagtgataagcattgtttctatagattataaactaactaaaaccattccttacgggaaacaaagggatgggctgaaacaaagagatgggctctggctagttatttgcagcaggaatatgtccttaaggcacagatggctcatgctattgtttgtggcttaggaacaccttaaacagttttcagccctggctgggccaggtgtttcttgccctcattctggtaaacccacaaccttctgtgtggacatcatggccatgaggaacatgtcacagtgctgcagagattttgtttatggccagatttggaggtctgttcccaaaatgttccccctttttgtttttgcaagatgataaaagcaaaggtggatttatcacagtgagctacttcttgcaggagtcgggattcgcatctgcagactatacaaagacaacacagattaaaagcacaatcatcattgaaatcacagagcctccaagtgttgttatccatattaatgggttactagctcctaacctgtctgcagctccttcaaggactccagttcctggcattaaggtcaggtgtgcctgggatgctttaaatatttgttcttttaattttgtaatatccaaagacaagtttgcagagggtccttctagatgcttttttattcttttccaaattttgatcttattatgagccattaatagtttccacaaatccttaagtttagctcctacagcaggccacgtcatttgaggttgaggtgccactatgtcgccatgtttccaggtaataggaactcttgtcagatttcttaccatttctaccatctgaccattttcttccaaccagctgaacatagtgtggctgtggcacgcagactgagaggtgcaattcaagccaaacatccccttaggggaccaatcaataatgattccataggaatcgttgcacagcacctctgcctgttctgcaatgcaatcttcccaaacaagtacattcattttttctggccaggtccacttctgtttatgaataagtttttgaaggcagtatgcctcaattataggagcagatttattatggtaaatactgagatcagaaaggatgtgtaaatgtgtcatagaatgtttacatccaggcattattgccagccacgattgataaatatgcccaataaatagaattgttctctgtgtcagcctttgctgaaggaatactcgtggcaatggtgatcaccactatcacagctatcattaaattactcattgttactggttgtcccactttcctcaggttttcttccaccatctgtgacagcttcttgatttgtccccaggtgggtggctgtgttcgacgggtgttgctcgtgacagttggagtcctcctcagtgtcagtctcaacatggctgcaaccttagggtcctcgggatcctccaggaatctcttccttggcatctggttcatgataaggtttcaggtgtcttgatggtatccaaatcagctgctggttttggcctggagaaacacaagcataacctcttccccaagttattatgttacctatttcccaactttttgttatcggatctctccaccaaaccagttgttctgcctgtgtctttgcagctggtttctgtagatgctgttctgctgctgatagaatctggcctttaggtaggcttaacaatcaccatcatcaaaaatgatatcctaaaccttggtgggaactttgtcttcccacttgaagtggttccttcaaaccttgaaaattttttcctagtcccgtaccagggacataccccatttcaggcatcatatgttgactttgagggctatataattgctctggaattagaatttgtgctccccattgttgtgataaatctctcccccataaatttaaaggtacagaagttacagttggttgaatagtcctaggttgtccatcgggcccttcacaatgcaaaatataactgctttgatatacttcaggggctttactaactccaactacgttaaattgagtgggttgaattggccacagagatggccagtgctgtagataaatgattgaaatgtccactcctgtattgaccaaacctttaaatttctttccctgaatagttatttaacaggtaggacatttatcagtaatttgattcacccaataagctgctttgccttgtttatttgtgcttccaaatcttcctgttcatttaatttcacttttccccatttccacatatggcacaatcaggagctgtgctatacgctctcctggctctgctttccagggaacagaagtagatataacaatttgaattttcccattgtaatctgaatcaatgactcctgtttgtacttgcactccttttaaatttaaactagacctacctagaagtaatcctatcatcccctctggcaacatctgacgggagacagcaacattttttaacagtcccattacaaaaggagaacctggtccatattgattaatagcttgtttaaaatctttgagtactttaaaaggaaaatctcaaatgtagctataatatttccctgttgatcaggtgggtgtattctaacagggaactgccaagcctttaaatcaccctcttttctagcttgctggattcctgcctgaatagaactgaaagtggtcactcgagacactgctcgaacagtcacggggccagctactttttgcccagtgtccttcagaaaagaaagatctggaaggtcaggccactctttttcttcaaaataaggagggggtgcagaagggtagggatgaacctcttcctcctttgccactttagctttagctggcaaacaaacctgctgtgttacctcttctgttagtttgttatacttcccttcctcctcctcatcagtatgaaaagcttccaaagtggatcgaaccagagcccacacttgtcccattgttaccctgatgcttccaagctccccttcttattcaccacggggattgcttaagagtactcaggtgtcctccagcttcatttcacattctccaaccatcgctctggtgaccctttgacctgggttcgagccccacatatgggcatgacttgctgagaccagcacagttgtggaggccctaatccagcagtgctagaggaattaaagacacacccacagaaatatagagtgtggagtgggaaatcagggggctgacagccttctgagctgagagccacgaacagagatttgcccacatatttattgacagcaagccagtgataagcattgtttctatagattatagaatagctaaaagcattccttatgggaaacaaagggatgggccaaaacaaagggatgggttctggctagttatctgcagcaagaatatgtccttgaggtacagatggctcatgctattgtttgtgacttaggaacaccttaagcagttttcagccctgggtgggccaggtgtttcttgccctcattctggtaatcccacaaccttcagtgtgggcatcatggccattaggaacatgtcacagtgctgcagagaatttatttatggccagacttgggggcctgttcccaaaagaaactaaattttgaatggaattaccattaatatatattggggttttatgggaataaaatatcataggtgaattaaaattaatagataataaaatttaataataaaaattaaatttatgtaaaatatgaaggaataaacattcctttttctaatatacttcttcataaaaggataaaagtagactgattattatgttatcaaatatttaaagataaaatgtttgtacattgatagtcattgggtattcgctaaaacacttttcaaaagcttcataatacaaacgttagaatggtaaactgtgtctttctggacatagattactaaagttatatagacatatataggcctagggatgacaatttttataaccttagtacagttggatcttgaataccatggtggttaggggcattgacttcctgtgtacctgaaaaaaaaaaaaaatatatatatatatatatatatatacacacatacatatatatatataaatatacatacatatatatatacatacatatatatatataaatatacatacatatatatatacatacatatatatatatatacacatacatatatatatatattctacaatggaaattagaggtttcacataaaaatcagctctctgaactttaactcaagaaggaaaagagaaatccaccaaaatcagaaaaaaagccccaaaccctggggaggagatgcaggcaaatagcccccttgacagcatctggctgataaaagtgagtaaagttccagtacacgtgagaggcagagagcctccctctgtgacttacctttccactggggatctgagcaacccaggctgagggagagcactttgtttcccccaagcccaggactattttgggaagagacttggaggtctgagagagaaagagagtgagaaaagctgcaggcatttcccatggaccctcaggactaagagcaggatgccattctgaatccaggttaaaacagtcagccattctttggtgacctggcagcatggccctgcaggcatttcaatcgtagactagagattggagcacttgctctggagtggagtaggggcctccacaaccagaatcataaagagctactcagcagcagtcactgcagttactttcttccccatcccaggcctgggttggggagagggctgctacagctacagtttttgctgggtgatttgaagccagagccaccttggtgacctggaactggtctaagtgagtcactgctgggtgtcccagcctgctcccctgagattatggtgcaccagggccccctcctctctgtgcctaggaagatctccaagcatttggagcactcattcacattgactagcaatgcgagacaccccatccttcttgtgcagagtcctctccaggccatgcccaagcatattcccaggtattcagagcacccattctgctggatcagcagcttgccccagcccactctccttgtgcagagatcctggtgcagggagtctctctccactttatgtttaggcaagtctgtaggcattgagagcaactgctcacctggttcagtagttccaccctacttgccctggatatagattgtgatgcagcacggccctctctgttgcatgcttagactgatcttcaggtagtcaaagtacctgctcacccagattggtagcttgagccactgtaccctttttgtgcagagatcctggagcagagattgtggtgcagcagcaccctctgcactacccactcaggcagacctccaggtacctggagaacccactctcctagattgagagtttaggccagcctttctaatcatgcagaggacttggagctgagaagatttatcagctcaatgcctaggtgcacctctgggtgcttggaggccacccattagattcttctttagcactagtgcttgtgcctgtcatcaagggtcctgcaggtgggcatgcctagtctggacctgcccatcatagtcctcactccccagggctgaacagggagctcaaaccactgtgcaatccacagatcagtccattgcctgaggcaacagagaccttctctcagtaaacaaggctcaggtatatacccagccatattagccccatccagttcttatccataaataccatctactggcttgtaggttggactgcaaagataagtataaaacccaccaaaagaagtgcaaaagcaaaaagaccttacccaacattctctaccttacccaacattctctatagtcacaccccctagggagggggaaaagggaaagagaaagagacagaaaaccactaagtttataaagaaataaagtaaaagaaaaattcctacctgtacaaaaataattacaaaaatcagaagtgccagaatctccagataagaagaaaccaacacaagaattatggcaccataaaaattctgagtgtagtgacaccacgaaaggtcacactagctctcctgcagtggtccctaaccaaaatggatactcagacatgagagataaggaattcaaatcttttttttttatatgattgttgccacatgtatgtctccttttgaaaaatgtccattcatttcctttgcccacttttttatgaggttgttgttttttttttttttttgtaaatttgtttaaattccttatagatgctggatatcagacctttgtcagatgtgtagtttgcaaaaattttctcccattctgtaggttgtctgtttactctattgatagtttattttgctgtgaagaagccctttagtttaattagaccctgtttgtcaatttttgcttttattgcaattgcttttggcatctttaccatgaaatcttttcctgtgcctatgtcctgaatggtattgcctagtttgtcttcctgggtttttatagttttggattttatatttaagtctttaatccatcttaagttaatttttgtatatggtataagaagggggtccagttttaatactctgcatacagctagtcagttatcctagcaccatttattgaataggaaatcctttcctcattgtttgtttttgtcaggttagttgaaggtcagatagttgtagtcttattttgtggttctgtattttgttccattggtctatgtgtctgctgctttgtttactgtagccctgtaatatagtttgaagttgggtagagtgatgcctccagctttgttctttttgattaggattgttttggctatttgagctcgttgttggttccatattaattttaaaatggatttttctagctctgtgaagaatgtcaattgtagtttaatgggaatagaattgaatctgtacattgcttgagcagtatggtcattttaacaatattgattctttctatccatgagcgtggaatgtttttccacttgtttgtgtcatctctgatttctttcagtagtggtttgtagttttccttgtagagatctttcacctcccttgtaaattgtattcctaggtatttttttctttttgtggcatttgtgaatgggagttcgttcctgatttggctctcggctttactgttgtcagtgtataggaatgctaattatttttttcacaatgattttgtatgctgagattttgttggggttgtttattagctttaagaagcttttgagttgagacaatggggttctttagatataggatcatgtcatctacaaactgagatagtttgactttctctcctcctatttggatgctctttatttctttctcccgcctgattgccctgagcagaacttccaatactatgttgaataggactggtgagagagagggcatccttgtcttgtgccagttttcaaggggaatgcttccagcttttgtccattcagtatgatgttggttgcgggtttgtcatagatggttcttcatatttgaggtatgttcctttaatacctactttactgagagttttgaacatgaatgaatgatgaattttattgaaataattttctgcatctatttcaaaaagatgtgctgctggatttgctttgccagcaccttgttaaggatttttgcattgatgttcatcaaggatattggcctgaagcattccttttttattgtatctctgccaggtttcgatatcaggatgatgctggcctcatagaatgagtgagaaaggagtgccttctcctcaattttttgggagtagtttctgtaggaatgatttcagctcttctttgtacatttggcagaattcagcagtaaatccctttggtcctgggctttttttgttcggtagactatttattactgccttaatttcagaattcattatgggtctgttcagggatttaatttcttcctgattcagtctttggagggtgtatgcaatcatgaatttattcatttcttttagattttctagtttatgtgtatagtggtattcataatattctctgatggttgtttgtatttctgtggggtcagtggtaatatcccctttgttgtttctgattgtgtttatttaatcttttttatttattagtctagctagcagtctattttcttagtttctttttttttttttaaagaaaaaaacaaacagctcctggattcgttgatcttttgaatggttttttcatgtctctgtctccttcagttcacagttacagttcacctctgattttggttatttcttgtcttctgctggctttagtatttttttgctcttggttctccagattttatagttgtgatgttaggtcattaacaaaatctttctaattttttatgtgggcattcagtgctataaatttccttcttaacaacatcgcttatcattagaaaaatgcaaatcaaaaccacagtgagatactatctaacaccagtcagaatggctagtattaaaagtcaataaataacagatgctggcaaggttgtggagaaaaaggattgctggtgggagtgtaaattagttcaaccattgtggaagacagtgtgacaatttctcaaagacctaaagacatatataccatttgacttagcaatctcattactgggtatatctgaaaggaatataaattattctattctaaagacacatgcatctgtatgttcactgcagcactattcgcagtagcaaacatgtggaatcaaccgaaacgctcatcactgatagactggataaagaaaatgtagtatatataccatgggatactatacagccattaaaaaataatgagatcatgtcctttgcaggaacatggatggagctagaggccattatccttagcaaactaactcaggaacagaaaaccaaataccacatatcctcacttataagtgagaggtaaatgatgagactacatggacagatagaacagaaaaacacacactgggcctattggagggtggagggtgggaggagggagaggatcaggaaaaataattcatgagtactgggcttaatacttgggtgatgcaataatctgtacaacaaaaccccatgatacaagtttacctatgtagcaaacctgcacatgtactctgaactaaaaaaaaagaagtagaatgattgtttgcccttgaagttatattgttgtcagttttaattcaattgttataacttaaaaaaataagaatttgaagcacagattacaaggaagcttgacaagatccaaaacaatgttgaaaatcaacacaaagagatttctttcctttttttttttttttttttgagatggagtcttgctctgttgcccaggctggagtgcaatgggatgatctcaactcactgcaacctctgcctcccaggttcaagcaattctcctgcctcagtctcctgagttgctcagattaaaggcacccaccatcacatccagctaatttttgtatttttagtagagacggtttcaccatgttggtcaaactagtatcaaactcctgacctcaggtgattcacctgcttcggcctcccaaagtgctgggattacagatgtgagccaccatgcctggcctaacacaaagaaatttctaaagctaatcaagaaataaatgaagaggtgaagatatttaaaagaaatcagttagactttatggaattgaaaaactcatttaaggaacttcaaaattcaattcgaagctttctcaatagactggaccaaatagaagaaaaaaaattcaaaactcaaaaactggtctttccaactaacccagtcagacaaaactaagaaaaaaaataattttaaaaatgaagaaattcttcaagaaacattggattatataaagcaaacaaacctatgaattattgtcatttctgaaagaggaggagaaaaagtaaacaacctgaaaaatatgtttgaggaaataattcaagagaatttttctaattttgctagggaagtaaacattcagatacaagaaatattatacaagacaaacatcaccaaggcatatagtcaccagattgtccaaggttaactcaaaagaaaaattcttaaaatagctagagaaaaaggccagatcatgtacaaagggaaccccatcaggctaacagcatacttctcaacagcaaccttacaatccagctaaccttacaatcaaagagactgaaagcctattttcagcattcttaaagaaaaaaaatctaaccaagaatttcatatcccattttcataaaagaactaaagcttgtccagagaagcaggcacaaagggaatttgttaccactagactagccttaagagagaactttaagggatttctaagcatagaaacaaaagaatgatacatgctaccacaaaaactcaattaagtacatagctcacagaccctataaagcaaccaaacaatagaaactacaaagcaaccagccaacaagttcataataggatgaaaacctcatatatcaatattaaccttgaatgtaaatggtttaaatgccccacttaaaaggcacagagttggaagttttgtctgtgtgtgtgtatgtgtgtatatatatatatatatatatatatatatatatatatattcatatatataaagaccctttcgtctgttaccttcaagagaccatttcacatagcctcaaaataaaaggttggggaaggagctatcatgcaaatggaatacaaaaaggagcaaaggtcactcttcttatatcagataaaacagaccttagatagtaaaaaaggataaagaaagaaattacataatgataaagcattcaatttaataagaagacttagctatcctaaacatatatacaaccaacatttgaggactcagattcatacaacagcaacttctagatctatgaaaagactcaaacacactataatagtggaaaacttcaacacccaaatgacagcattagacagatcatcaaggcagaaaactaacatagaaattctgttcttaatttcaacacttgaaccaactgaaactaatggaaatctacagaatactccacccatcaaccacagaatatacattattctcatctacacacagaacgtactccaagattgaccacattttcagccataaagcaagttttaataaattaaaaaaatttaaatcatactaaccatactctcagaccacaaaggaataaacatagcaatcaatacaaagaaaatctccccaaaccacacaattatctggaaattaaacaacttgctcctgaataacttctgggtaaacaacaaaatgaagtcagaaaaaaaatatttgaaataaaagaaaacagagacacacatagcaaaatctctaggatgcagacaaggagtgttcagagaaaaatttataacaccaattttctatttcaaaaagttaaaaagatttcaaattaacaatataacactaaacttaaaggaactagaaaagtaagaatgaacaaatcctaaagctagcagaagaaaataaataactaaaatcagagcataactgaataaaattgagacacaaaactccttggaaagaatcaacaaaaccaaaagctgattttctgaaaagataaagaaaattgatagactgatagctagatgaacaaagaaaaaatagtgaagatccaaataagcacaatcagaaatgacaaaggttgttacaaccgatggcacagaaacacaaaaaaatcctcagagaatgttataaacacttctaagcactctgatatcatgtggatgtttgttcccgctaaatcccatgttgaaatggaatcctcagcatgtagggcctggtgggagatgattaggtcattggggcaaatccctcatgaatagcttagtgctgtctttgtgatgagtgtgttcgcactctgagttcatgtgaaatctcattgtttaaaagagtgtggcacctcctgctctctcttgctcccactctcaccatgagatacgatggctcccccttctcctttgaccatggttgaaagctccctgaggcctcaccagaagcaaagcagatgctggcatgtgctttccatacattctgcagaactatgagccaataattctttctttctttataaatcacccacctcaaatatttctttagagcaaagcaagaatggactaagacacacgcaaaatagaaaatctagaggaaatacataaatttctggaatttataatttcctggaaacacacaacctccgaagattgactcagaaagaaactgaagccctgaacagaccaatattaagttccaaaactgaaccagtagtaaaaaacttaccaactgaaaaaaaaaagcttcagaccagatggatttacagctgaattctgtcaggcatacaaagaactgctagtaccaattctgctgaaactattccaaaaaacttaggggaagggactcctccctaactcattctaggaagtcagaatcaccctgacaccaaaacctggcaaagatgcagtaaaaaaagaaaactataggccaatatcccccaatatccctgaaggacttagacacaaaaatcgtcaacaaaatagtagcaaatcaaaccagcagggcatcaaaaagttaattcaccactatcaagtaggtttctttcttcttatgtaaagttggctcaacatgcagaaatcattaaatgagattcaccacataaagagaatttaaaacataaaccatatgatagtctcaatagatgcagaaaaaacctttgataaaatccgacattctttcatgataaaaaccctcaagaaactaggaaagaacatacctcaaaatactgagagccatctatgacaaactcacagacaacatcatactggatgggcaagagtgaacgggcatttcttttgataattggaacaagataaggatgcccattctccccactcatattcaacatagtccttgaagtcctagccagagcaatcagacaaaagaaagaaataaagagcatccagataggaaaaaaggaaggaaaactatctatcttcagtgataacatgactctatactgagaaaaccccaaagactctgccaaaaggctcctggaactgataaatgacttcggtgaagttttaggatacaaaatcaatgtaaaaatatcagtggcatttctatataccaataacattcaaactgagagcaaaatcaagaacacaatctcatttaaaatagtcacacacacacacacacacacacacacaatatttaggaatacatctaaccaaggaagtgaaagaactctacaagtagaactgcaaaacactgctaacaggaattgtagatgacacaaacaaatgaaaacattctatggtcatggataggaagaatcaaaatcattaaagtggtctatactgcccaaattgatctataaatttaatactatttcatcaaactagcaacgtcatttttcacataaatagaaaatctattctaagattcatatggaaccaaaaaagagcctaaataaccaaggcagtcctaagcaaaaagaacaaagctggaggcatcacattacctgacgtcaaactatattataaggctacagtaacccaaacagcatagtactgctacaaaaacagacacatagtgcaatggaacagaatagagagctcagaaataaagtcacattcctacagccatctgatctttgagcaagttgacaaaaataagaaatagagaaaggaattcctattcaattagtggtgctggaatagctggtgagctatacatagcagaatgaaactgaacccctaccttttaccatttacaaaaattaacttaagatgcattagacatttaaatgtaagacctcaaatgataagaatcctacaagtaaacctaggaaacaccattctggacattggccttggaaaagaatttgtgtctaaatactgaaaaccaattgcaacaaaataaaaaattgacaagtgggacccaattaaactaaagagcttctgcacagcaaaagaaactatcaagggagtaaacagacaacctgcagaatgggagaaaatatttgcaaagtattattggataaaggtctaatattcagaatctataaggagcttaaacaattcaacaagcaaaatcaaataattccattaaaaagtatacacaagacatgaacagacagttctcaagagaagacatactattaatagcagcgtgaaacataaaaaatggcttaacatctctaatcatcagagaaatgcaaatcaaaactataatgagatatcatctcacaccagtcagagtggctattattaaaaagtcaaaaaacaaaacaaaaacaaaaacaaacagatgctagggaggttgtagagaaaaggtaatgcttgtaaactgctggtgaaaatgtaaactagttcacccactatggaaagcagtttggagatttcttcaagaacttaaagagaactgccattaggcttcaggaatcccattactgggcatatataaatgaaaacaaatcattctaccaaaaagatgtatatacttgcatattcattgcagcactattcgtaatagtaatgacatggaatcaacctaggtgcccattaatgtagattggattaagaaaatatgccacatatacagcatggaatactgtgcagccatagaaaagaattacgtcatgtccttgtcagcaaactggatgcagggggatgctattatcttaagtgaattaactcagaaacataaaatcaaatatcacatattctcacttataaatgggagctaaacattgtgtactcgtggacataaaaatggcaacaacagaaactgggggctactagagggaggaaggaggaagtggataaggtttgaaaactaactgttgggtactatgttcatcatctggatgat

SEQ ID NO: 512 - DNA, 25809 bp, Homo sapiens
agccaagatcgtgccattgtactctaacctgggtgacagactgagactccatctcaaaagaaaaaaaaaaaaagctttatacggtctgaccccccccagtaggaagaacacatgggtctggaaaccaaacggcataagtggccttatcattgctcccgaagacccagcagtggaccttgtgtttcctagtcctgcaactctgggctctgcagggctggaggtcctgatccccaaggaatcacacttttgccaagggacacaaaagtctcagtggattatgagttgcacctgcaacctaggcacctccggctttttgtatgaccctgatcagcagatcaggtgcacctcagctcctcaagtcactccttgtgccatttgtgatgccaactggactagtgtatcctttctggcctaagaaggacatgatgaccagggacacagaccccccagggatgagggctgaccaccccaccaggtaagcccccaagaccagcaaagatggtggctgggcctgcggctctccgggacacagggtgcaggtgaggatgagcatctgctgtggctcagggacagcggcggcagcaggagttgcaggtcttccttttaacctccctctcctcactttccccagaagagaggtcagcagcaagctggagggcctgtttcttggtgtccatggagaagtctatccgagcagtgctgagatggatgaaagggaacacagaggtgcccaaccaggcccccaacgaaggacatagccagctgctgggagctaacagcagatagactttagccagagttgtattctggttggcctcagctgtagagaactacctcacccacttggatacccttcttcacaggatccaaaatgacagatagtggtgggagcagacagggtcggccatgccggcgcaccccaggatgactgacccgccaggtgctctgcagctcccatggctggcaaaggttgtgtggcagtttggcttctcccgctgcccagtcctgtttcttccttccccgtcttttcacagaggttgatcccaatcagtatcctgcaatcccaaatccatctccttgtctgccttctgagtgtctagacagcactgatgactatgtatgcaacatgctcctacacacttagaaaactctctggacaaatgcacaccaaaaaactggttcgtctcgggggagggtaagtgggtagcttgggacagggagtagaggggaatgtactttttatcgttttccccttttggatcatataaatttttgtacaataaacatgtatttcactcaaaaacaaaaattttaaaagtccaaagaaaagaaggtctaaattattagtataagttattgtttgatcttggtataatgagtgggatagaagttaaaaaagaagaaatgttcaaaatggaaaacagcaggagagaaagagaaaaagtagagataaaaagaagaggaaaagtaacagcaaagcagagaaaaaacattttatgtggtggtttggaacgtttgggtagtgtgaaaagcttgcccttggtgtcttccaatttcccctctcagacctgctccctatcctaacaagcaccacctctatcccccacaaccttccaccatgttatctcttgctgtcccttggaagctccaagcacagatctctttgttgttgttgttattgtttgagatagagtcttgcactgttgcccaggctggagtgcactggcacaatttcggctcactgcaaactccacctcccgggttcaagtgattctcctgcctcagcctccctagtagctggaattacagatgcataccaccacacccaactaatattttggatttttcatagagacagggcttcattatgttggccaggctggtctcgaactcctgacctcaggtgatctgcctgccacagcctcccaaagtgctgggattacaggcgtgagccactgaacccagccagatttcttttttttcttctttattcttctagtgtccagactttgattataattaatcaattaattcatcgagcaactatttattaaatattcagggtatatttacaagggaagaattgtggtatatattccaaaacacaatcatgttgaggtgtgcatgaataacatgaccctgattaagcgttagccaagacgtttgatttaaacatttaaaaagaaaactccaaagatataagtgttggaaatacttagaaactaatagtgagctcacctctgtgctgtcctggtgcacaggtggtgtgtctttacattgctcctggtgctacaaaaacagttagacggctattgtcattttaagaccatgtgtacagattccagctgtccaggatttcaacatcccaggtagtcacctattcacacctgagtgtatgcaactaagctgtgcgctgaatactttgtgcaaaaacgcccaaaggggactgtggggtggaggggactggggggtggaggggactgcggggtggaggagactgtggggtggaggagactggggggtggaggggactgcggggtggaggagactgtggggtggaggggactgtggggtggaggggactgtggggtggatgactcccaagtgcaccaggcaggtgactggtgaatatgctacagtgctcggaaatataccaacataccccccacacatatttattttcaggaagggctaactgttgcaatttcacccccctttctcccagaagaatagatcgtacaccgctcggttgaaatgaagtagtttcatcagttctaacaaatgcgccacgctggtaggggtgttgatagttggggcgctgtgcgggtgtgagggcaggaggcacaggggaactctctctcccttccactcgagtttgctgtgcgtctaaaactgctctaaaaacaaagtctatttgaaaagaaacctcgcagttgcagtccccacaactgcctcccgctgctgccccataccctctgctccactttggagcacagcctctcagatgagctgttggtccagcacctctacagcatctccatgcaggtgccgattgccacggccggagcagagctctcagctcctcataatcctaaccagctccctatcttagtaacttatcttagtaactggcaacatctttcactgagtacgcaagccagaaatctgagtcacgttgattcttctcttttcctcccactcaaccctgctgcatccaatcaatcaagttctgtgggttccacttttaaagtagattccctaagtggtcactgcttaccgtctccactgctatggcctcagacctcaccaccgcctcttcggctgacaaatgcaatgaccccatcacttctcctctgctcccaaccttcccatagtttcccatcaactcagaatacaatcccaaactcctcacctggcctacaagtccttcactgacgcagcccctacctactttttccacctgcatctctgacctgggcccctggctcatgcagtcacgccagcctgcttgctgttcctgggacatcgagtctttcctcctcagcgacgctcttcccccaaacagagacatggtttgttccatcactgtatcccggctccatccaatggctttcctcaacttcgtcacctgaatgagcatcctctccaccccatccctggcatgattgacttacctgcattgttcttctctgtgagactcaccatccagagcattacaccatattttcatctgattatttgcttcttgtctgttcacctcctcagaacttgagcagcattataatagcatggatttggtctgtcttattctcaatatgatacaagtacttatgtacctggcacatagtaggtactcaataaatagtagtggcaacagagcaccaaaaatgagctcggcagaaaatgaagaattccattatttgtcttaaaaaggcagacaagctaggcacagttgctcacgcctgtaatcccaacactttgggaggctgagatggttcaatcccttgatcccaggagtttgagagtggcctgggcagcatgatgaaaccctgtctctacaaaaaatacaaaaattagccaggcaaggtggcacgagcctgtaatcccagctactcgggaggctgactgggaggatcacctgagcccgggagttagaggctgcattgagatcatgccactgcactccagcctgggcaacagagcaagatcctgctgtctcaaaaaaaaaaaaaaaaaaaaggcaaataagttactaacatggggaaatatgggtcataaaggagagagctggctttttcagaaaaagacagttattaggtatccaacaacagataaatggataaagaaaatttggtatatatacacaatggaatactgttcagccataaaaaagaatgaaatcctgtaattctcagcaatatggatggaactggaggaattataaaaaatgaaataagccaggaacagaaagttaaacactgcatgttctcagtcacatgtggaagctaaaaagtgtcagtctcacagaagtagaaagtagaaggaggatacttgagggtgggaagggagatgggaagggagtgatagggacagatttattaaaggatacaaaattacagctagacaggaagaataagttctagtgttctgtactactataagatgactacagttaataatgtattacatagtttcaaatagctagaaggaggtggggcggtggctcacacttgtaatcccagcactttgggaggccgacgagggtagatcacctgaggtcaggggtttgagaccagcctggccaacatggtaaaaccctgagtctactaaaaatacaaaaaattagccgggtgtggtggcgggcacctgtaatcccagctacttgggaggctgagacgggagaattgcttgaacccgggaggcagaagttgcagtgagctgagattgcactgttgcactccagcctgggtgacagaacgagactccatctcaaaacaaaaacaaaaacaaaaacaaaacccaaaatagctagaaggaggatattgaatattcccaacacaaagaaatgatggatgtttgagatgatggatgtgcgaattatgctgatctgatcactgcacgtcatatgtatcgaaacatcactatgtacgcatgaatatgtacagttattatttgtcagttttaaagtaaaatttttaaaaagaaagagaaagagaaagaaaaagacaagtgagagaactagaaattcatcccacacccaccagggatgaaattagcctaatctcaacagagttcagtctcttcatctaacagacaaggaacagaatctttcatcgcatgttggggaggggaagaatgaggttactcaaacaaaaagtttcgaacttctcagaaaaaaaatgaatttcgtcaattcgagatactgttaataccccatctggccatgattgacgaaacagacctttggattccgtgaaacgaaccccttgctaatgtcgcttctgggttcttcagaccttcttggcaggtggctggcttctctgttctaacttaaccctccagatgtcacatgaaaaaagtatgcttgttatgaaataatcctctggcttcattacccaggaagtccctgctttgtttttggtctttgtttttattttctcaagctctgacagaagtttctgggggaaactgtgggtctttatggatgagggtgaagttgtttagaaactaaaataaacaagatactgtattttcttcctcacgctctcttgctcatgcactcagaagacaaaggtacccccttcagttcccagaagctggtctgctcttttttgtttgttttaattgtagagacacggtctcgctctgtgcctaggctggagtgcagtggcacaatcggtagctcactgcagcctcaaccttccaggctcaaggatcctgccacctcagcctgctgagtagccgggactactggcacgcaccaacacacccagctaatttttaatttttttctagagaatctggtctcactatgttgcctaggctggtctcaaattcctggtcccaagcaatcctcctgccttagcttcccaaagtgctgggattacaggtgtgagcccccacacccagcccacttccgctcttagggagaggcgagtgcatttcagagagcactcgatgctcccaaaagaagaagttgacagagcccacgtcccctcagcccttcacacagcctccccttgtcttcctctcctactcagcactgtggctgcactaggacccctcatgatgaccaagatcctcataaagaggacaagaagttcatccagtaccagtcaggccaatatcccaaaattagcataactggcagaaatgcagaggcatcaacaactcctcttgacaacagggttggtagaagaatcaagggcctaattttgatgcctggcacaggttatgggagcagcagagtacatgctgcccagcggcttccagaagctcctggtccaccccgtcaagaagccggaggtcctgctgaggtgcaacacatctcagtgtgctgagactgccctcaatgttgcccccaagaactgcaaagccatcctggaaacagtggcccagctgcccattggagtcaccaatcccagtgccaagctgtgcagcaaagaaaaggattagactgctcatgtgcacgttttatttgtttttaaattaaaaaacaaaaaaaagaaagaaggaggaagtggaggaagaggaaggaggagggaggaggaggaggaatttacatcagcaggccgatcacatactagtccttgaattcatggttgaatgtactgaccattctccctacggacacttgaaggtttccatcaaacccttcataacatattgcataattgtggactctagacttgggccacaactgagtgattttttttttctcaaacccaattccacaaagtaaaagcctgatgaaatacagtgaaggctgatgccttattaactgtgtttcccaaatccagagctctaaaaaggttctgcatacagtcattcattcaatgcttaacgactgagcattaattccatgctaagtactgaactcagcactaggaataagaaggcgacctagaggcatatcctctctctaaagatgcatagagcctcattggaatgatcagccgtgtctccagagagctacaaggcagttttcaattggtaaatgccctgagagtgatgggcttgtggcatgtgtaagggttagacagacctgggacctagacatgacaccactcctgacgaattatgtgagtgtgggtgtttcacaaccacaatgagatgcaatgcctgcacttgtaacatggaaatagtgatggcatgccggccccgccagattgctgtgagaagtcagcggcagagacatgcaacattctcagcacagtgcttgccatgtagtaagggcctagtcagtgctagtgattcctttcaatattcctaagatgcagataagggaacagcccagaggagggggagcacttccagagggagggatgcggtgagacttccttcagcagggtagcactggagctgggtgttaaggagtgagtgagctttgggcttatggatttaacagaggaaaccaagaaaagaggaggcggtgttgcaggaacagtgagcagttgatgatttttattttgttctctggtctgcttgggaacatttttgtggcaaagacagcatgaaggatagcgaagaattaatactgaagagataggccagggcaggttatgaaggattttgaataccgggctaagaaatgtgggcttaatttcaaagacattatggacactcctaaaatgttacgttgtagataagggaaaagtattcttccagaagattaaattggggctgggcacggtggctcacgcctgtgatcccagcactttgggaggcgaagtgggcagatcacctgaggtcaggagtttgagatcagcctggccaacgtggtgaagccccatctctactgaaaaaaaaaattagccgggcatggtggtgggtgcctgtaatctcagctacttgggaggctgaagcaggagaatcacatgaacctgggaggcagaggttgcagtgagccaagattgcaccactgcattccagtgggcgacagagcaagactcagtcaaaaaaaaaaaagattaaactggaagcaatgggtaagaatggtggagtggagagacacatttgagtgagggaagccagctgaaaagctgtacagacgtctagacaaaatgtgacacaagcatgccttcacctccctgcaaagaccacagaccactgagctccaaagggggtttggaatccttgtcctgggccgccattggtaactcatcagtgctggcttgagagataaactctattatccatccctgaactaaaatcatgacagaagtggccagggagctttgctgctatccccccaggaaacacgtcctccactcaaatggaaagaggaccctctgacaacatctgtgggacccaacagcactggtcaccacaagccacaaaatgttaacaaagtcagttttcaattgttagggacggaggactcagttcatgattcatacaaaccaactgttctctcccagtgttttctgggtggcacaacccacaagtcaacagtggcttgggaactagacatttgagtagagttgggttatttgattcatagtggattttggttttccacgggacccctgtgcccttgtctagtagaatctggtggaaattacaaactgcagaaattcaactcagtgccgcaataacaggatgcacctgtagatttcgtagaattagcagcagcattctttcaataccagtttgagagaaataaccctgtttgcatagtgccaactggggcagaatctgaagtgtcttgcctgcctctcggccatgggaggcaccgatctcagcaacatctatccaaccgccatccacttaacaagcaaagatggaaggccctcgtgctccaggctatcctgcaatggttcatttgcttttgatgggattatcactttgacagatgtgcttgcaattaactgggggctttctgcttccaatccaaattcccacaggtggatcactggctcttggggagcaaaaacccttctttgtttgtttttgcttctcccagagcctgggcagagctccccattcctggatcctacgttgatatgcactgaattgaattatactaaagggtgcacccaagagtgcatgagcgaagtaaaatgtaatttgtgggacctcatgtggacatttcaggtccgtgtgtacaagataaaggagagaaaatcctgggggacaccacaggcctgggaaaatgacctcctactaagcctaacaagaacatccagtacataaacagcaggctctctgcaaccgcttcagtccttccactgccacgctcccagaaagcaaagggttatctcctgttcggattttggctctgagaccacagctcagcacatcactcctctagagaaaagaaagtctaagatgagagagtgaggctgctttcatgtggtgccagcgtatagtgcagggcaggcctgattgctgaacggatccctgcagacgtgagcggtcacttccccttttgagggcccatttcttttcctctttgaggagactgtgagcgtcctcagtgcagggctatgttttagcttcttggctctcctcacaggttctagcataattctttgattaattgcagtcaacgtttattgatggattatgtgacagaggtgaaattctttgatctgggtttcagcttttcctttcccccactccctcctttttcttttttttttttttttttttagaggcgaggtcttgctctgtggccctggctggagtgcagtggtgcaatcatagctcattgcagccttgacctcctggggtcaagcgaacctcaacgtcttggcctcctgagtagctgggactataggcatgcgccaccacgctcagcttcaccttttcctttccttgtgctcccctggcagatatgctggtaaacaatgaaccagtcaagaggacagcaacaggaggaaaatgggagaaaccccattattcgtggactaaacaggcttcccactagtcctggctcacagaggaagtcatgctccatgtttcaaatgtcctcaaagctcgttcaactccaaaatgcatgaagacaaaatgggaattttactcaagatttttgtgggctgttggggagaagagttaacattgcaaagcatattgcaaactcttatcttcaaatgattttaaaattttcttccaagctctttattatttctccagagctgccctgctcttcccactctgggtcctttctctgccactctcctcagcatgacttctccctaatcggccagcatttcttttattctatagagcaagttttcttgccctgggcacctctcatttgcatgttataccaccacaccaagtgagcctcagagcaccagtgttttaatccctgaaaacagtccttacgggattcagcacagaggtcctcttggcagcctgtagtctccagagtgacacgtcctcaacagtcaaagtgagcaagctatggtgcccatcaccaagtggggctcaccatttccctctgcgttcacttctctcctaccttcttccttatcccatccttcctccttcctttttttttctgcattcaattattcatggttattcatttcatacgggcatctgtgccacttggttctacaggcattttttttttttgagacagacttttgcccttgtcccccaggctggcgtgcagcggtgtgatcttggctcactgcaatctccacctcctaggttcaagcaagtctcctgccttagcctcccaagtagctggaattacaggcatgtgccaccaagcccggcaaatttttgtatttttagtagagacagggtttcaccatgttggccaggctggtctcaaactcctgacctcaggtgatctgcctgcctcggcctcccaaagtgctgggataacaggcgtgagccatcgtgctcggccggttctatgggcattgtggaagtgaccgttaacaagccccaagggtaagtaaaggaaaatgaaaggtgattgattcctcaccacctctccccttttttcctctactctttgcccctgctccccaatctagactctaataaacagaaatgatttttgttgcaagctgaaaactcgttcttgtggttggggctaggggggtggcaagtcaagctttagagttgtctggataataaatgctgtcttcaaggactgtccaacattgtaggaacaagagaacaacccaagtgaacaactaactcctgttcacaaatgctactgcctctctgccatcccctaacctcagcctcacacacttgaatttcgccaatccatttgatgagctcaaatcagtgaattttctcctcgccaaagctcacaaattctgttccccgcttcttgccccacatccaggcattaccaactgcattttccctttgcctgatattctggcatcaagcctccttgccattccaatttatttcaccttcctccagtccttatgatttccttcctgaagagtatttcagcatctctatgcctcaatcttccctgcacaccacaccagctcggcctcatcatcacatcacttggctatgtcccgcctgggttagacagcttcagtggctgaagtccatagatcttattctgtttttcgaggtccacctgactctgaatccagctgatatttctgcccttagcttctacccctctctacttctggttaactatggaccacactctgcttcctcaggaaccacctaccaaggccgtatccatccttcaaggacaatacgtgggcctttcctgatcacatcagctcaacaacttttccctcctacatttcaattgctcttcttaccataatcattagtattcaccccactgtacgtctagaaagaaagtggtcttaaacctaagggaaggcagtctaggtcagaaatttgttgtccgctgttctgagcagtttcttctaggaagtaccaaacatttctgataatagaattgagcaatttcctgatgaagtgagactcagcttgcactgttgaccggctgtccctggatgaacctagttacttttaaccaaatgttcctttcttgaacttgttcctttcttgaacttaatctaccaatgttatctagataactttcctcaaaaaaaaaaaaaaaaaaaaaaaccctctactaggaaagaaatctttgaaccggacttattggaaattacctccttgcagcaggtttgaaacaaaactttgaatttgcctcacaaagaatttgtctgaaactgctttagtatatgctagttatatttgtatgcacatgtggcttcatacatagtggttggacacccatatgtgttatgcactttgttaggtgacgtaagttcacagataaactggacatagggctatcctctagaggcccacagtttgacaccttaacctgagatccttggacctttgaagttcagagtgcccacaaccgctgggtgtggtggctcacacttgtaatcccagtactctgcagggctgaggtgggaggatcgcttgagtccaggagtctgagaccagcctgggcaacatgacaaaaccccatctctacaaaaattacaaaaaaaattagccaggcctggtggtgcatgcctgtggtcccagttacttgagaggctgaagtgggaggatcacttgagtcaaggaggtagaggctgcagtgagttgagatggcaacactgcactccagaaaccccatctcaaacaaaacagagcaaaacaaaacaaactgcccataatgctcctgaaacttcctacggatttatccagagtatgtgctgatgtgcattttttccaaggagggaaaccaaaggttctatcaaattaagaaaagagtttttaccattgtggaagacagtatggcgattcctcaagcatctaaaatcagaaataccatttgacccagcaatcctattactgggtatatacccaaaggaatagaaatcattctactataaagtcacatgcacccgtatgtttattgcagcactatttacaatagcaaaatggaaccaactgaaatgcccatcaatgagactagataaagaaaatgtgatacatatacaccatggaatactatgcagccatgaaaaggaatgagatcatgtccttggcagggacatggatgaagctggaagccattatcctcagcaaactaacacaggaacagaaaaccaaatgccgcatgttctcactcataagtgggagttgaacaatgacagcacatagacatagggaggggaacatcacacgccagggcctgctgcagggtggggggtggggtgtgaggggagggaacttagaagacaggtgagtaggtgcagcagaccaccatggcgcacttatacctatgtaaccaacctgcacgttctacacatgtatcctggaacttaaattaaaaacaaaaaagagtttttaatccaaaaaagattaacagcaactagaagaaagaaagagatataaacagtgaattgcaatgcagcacggcaggtgttatgatggagtagaaaggactggaaaaggcctcctggaggaagggacactcaagtgtctttccatttcacctgtaaactcattaagggcaaaagctttgctacagcttcagtatgagatcctgggcaatccgtgacaaaatgggtctgcttttgcacccccaacttcttctcacatccctgcatcgtgccatgcagcatcaactggaaacctcagcatcagcaaacgacgacagagcgttcatccgtaaggtgaaccagaaaagccagttcaatgacttgtttaaccatggtccatctcagaaccaagagttgggcctcttatttaccagaaaaattgtgggggctttgtgatatggctttaaaaaaatcttgtaattgccaggcgtggtggctcacacctgtaatcccagcactttgggaggccgaggtgggtgaatcgcctaaggtcaggagttcgagaccagcctgaccaacatggtgaaactccgtctctactaaaaatacaaaaactagctggatgtggtgacgcgtgcctgtaatcctagctactcaggaggctgacgcaggagaatcacttgaacctgggaggcagaggttgcagtgagccaagattgtgccattgcgctccaaaaaaaaaaaaaaaaagacattaacataaatttaaatattttataatgacaatccacattaactacttaaagcataagctattttccaggagaggcagcaagtgcattctactcccatgcccaagaagaaaggagcgtgactttggtgggagtactaggagtttctactggagcacttgcccgcagagtgagaaacgttcctagagaggaagttatacctgctgtggaatttaagagaatcttgtcatattttgacaagttttttgagatggaagtctcactctgtcgcccaggctggagtgcagtggcgcaatctcagctcactgcagcctgcacctcctcggttccagctattctcttgtctcagcctcctgagtaactgggattacaggcgcccgccactacgcctggctaatttttgtatttttagtagaaatggggttttaccatgttggccagactggtctcaaactcccgacctcaggtgatctgcctgcctcagcctcccaaagtgctggaattacaggcgtgtgccactgcgcctggctaatttttttttttttttttttttttttttttttttagtagagacggtggtttcaccatgtcatccaggctggtctcaaactcctgacctcaggtgatccacccaccttggtctaccaaagtgctcggattacaggcatgagccaccaggcccagtcaacgtgatgtgttttggaaccctgaattccttggcttgcccggagggttttctttttgttaatatctttgcttgctttctagtatttaaaaaattgtgttttgctctaactatgcaatggctttaagtcttagacaaatttccagggagcaaaacacactcaaccatttcataataatcagaagagagctctgatcaataaataagcaagactgaattttacaaaataatccaaagtttaaaaccaaagcccactttttgcatgatcctttaagagaaagaaatctggaagcaaaacaccttataaaatgacaatgcactttcaggagcccagggcactgtggtgaaatgatgatggctagtacaggttataagccttggggaattatttatgaattctcaggatccttcagttcgccgcatccttctccattatttgaatattggaggctgcctgaccagaatcttgtcaggactttgctccttcatcccaggtggtcccggctgactcctgaggacgttacagccctgaggggaggactcagcttatgaagtgctgggtgagaccactgccaagaagtgcttgctcaccctaccttcaacggcaggggaatctccctctccttttatgggcgtagctgaagaaaggattcataaatgaagttcaatccttctcatcaaccccagcccacacctccagcaattgaacttgaaaaaaaaaacctggtttgaaaaattaccgcaaactatattgtcatcaaaaaaaaaaaaaaaaaaaaacacttcctatatttgagatgagagaagagagtgctaggcagtttcctggctgaacacgccagcccaatacttaaagagagcaactcctgactccgatagagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcaggtaagggcctgtgggtgcccccggaattccgggaaggctgatgggcatccctcttcccagccacagaaccagagggagtccccaggtagatggttccaagaagggagttgaatcttgggttccacctcttgcctgtgacccacggggaccccagtttatgcctcactgttccttggtctgtcaagagagcctgaaatagcattaggttctcctgtccttctcagtccttgacaattaattctgggaagaatagtgtggcatgatatttgggatatttggatgttaacagggtcccgatgagcaggtttctcaagaaattatcttttattcttcaatgaatttccttttattctctgcactcccaccccccaactaagaagctatcaggaagctctttaagttcaggttaatttgctggagacatgagtactcatatatcaaacactgggagaatttaagatctcagaaaagtttagcttcaaggatgtatacactgcttttacgtcttaggaaataacacctaggaatttccttacaagtgcaactttacagaaatttttaaaaatatgcatactcacttttagaacattactacttctcataatcctatgtatatacatgatatgtatatgtatacgtgtttatatatgcaaattttaaatttcattccttgtttcaaatggattttctcgaagattttttttttttgacactgtctctgtcagccagactggagtgcagtggcgcgatattggcttactgcaaccttcgcctcccaggcttagcgatcctcccacctcagcctcctgagtagctgggactacaggcatacgccaccacacctggttaatttatttttttgtagagatggggtttttgccatgttgcccaagctggtcttgaactcctgggctcaagtgatccactcaccctggcctcccatactgctggtactacaggcatgaaccaccgtgcctggccaatatttttttttaaagaaataaaaaaccaccaacttctacctcaaaccactcttcctaattgagtgtgaattttctaataatgtcttccctttgcttactcaggaagacagataagaaagtttatagtgttttttgaaagtctataatggcaacaagtagaatgctaactggctgtagaaagaatttattaagaaatgaaacataatgatgcatttcaggagtctgcttgcttgtttaggggaagtgcccagtcatgctgggctgtgtactggcccagatgtaggagtgtctttaaagagggcattttatttacttattacatttttatttattttttttttactttttgagacagagtctcactctgttgcccaggctggagtgcagtggcgtgatctcagtccactgcaacctccacctcatgggctcaagtaattctcgtgcctcagactcctgagtagctaggtttacaggtgcgtgcaccaccacgaccagctaatttttgtatttttagtagagatggggtttcaccatattggtcaggctggtctcaaactcctgaccttgtggtccaccagccatggcctcccaaagtgctgggattacaggtgtgagccatcgcgcctgacctatgtgttttattttaataggttttggaggacaggtggtgtttggttacatgaataagttctttagtggtgatttgtaagattttggtgcacccatcacctgagcatgtatgctgtacccaatgcgttgtaagattttggtgcacccatcacctgagcatgtatgctgtacccagtgcgtagtctcttttccctcacccacctcgcaccctttcccctgagtcctcagagtccatcgtgccgttcttataaagagggcatacttttaggaaggtttttcaatgtgatttctacatccacagggtctttgctaactcagtctaagccaagaacaggaaaatcttgacaattaatcatgctctgcctctggaagacacatttcaagtaaactcgtgttatttctagctattggtgacttatccaagggtctgagtggtcttggagggagcaggggaactagagtcccataaggactccttcacgccattctcaacatctatccataccccatctgcccctcaacactataggaaatacaaaaatgagggagatatagtcctgacacttaagcaacttataacctggtgaggaggagaaaaacatagatataaatatagtaataccagtcagagtgtggtaagatctacggagcgttgggctatcagagaaggcttcatgaggatgacatgtaaagggagccccaagggaccagtaaatttccatcaatgagattccagggagagagaccccaatgagccaaaacacaggagtgccttagggagcagcaggtggtccaatgtgctcctgccctggacagggagggtggggatatggggaattcaaactggaaagttaggatgaggtaaaatgaatcatctaaggcattaggcatttttagtctgtatattgctgggccctgggatgtggtcagaaagagaattctcctagtgataacttcttaacttcacctagtaggcaataaagaactacaagaaaatttaaaactaccatttataaagtaacttctatgtgccagatatgtgtcctattgtaatcttcatagccactttgcagtatggatatcatgaacccctagatgaagcaagaacccaaaactcagactcgcacaggcagtgagagtgccagggtttgaacctggtctccctggattgttctgtttctgttcattgcaaacagggtcagcgctttatggagatgatactggcatagagtggagagagatcaggtgcacagagacaggtcatgaggctcttaaaatagtccaatcacaaggcaaatgaggacccagtggccaaagacaatgacaggggtcaagtttctggaatcaacaggaatttctaggcatcactccagggtaagaaaccatctcatcacagactttttctccaagaggaacctagtcttgaaacaaatcagactttttattcctcagggtaagagttctctaatgaaatcagactgtcaacagatgcaatttctagctgattcataagggcagattttcattctgaaaatttccaaagccaccatttaacatggcaagggtttatgaggacatattagtcaacttgagtgtttttagtctctatattactgggctctgggatgtggtcagaaagagaattctcctggtattaccaatatggcacgttattgaaggcacctttctcagaactgtggaaattctgagagcttgtatgtcccttgatcatctttctttcattctaggaattctgtgatcaaatctttatcctctagactcaaaaataattctttaaaaaaacagtgtggaaacccattgagataatgtgtttgtgtaattatccattcttgtaaagacaactgcccacaatggaatttcccatcttcacctttgtcagtcaaacacaaaatgtttaacccttcacatttaatctttcaacttcttgagatcccaaagtattattgctactgttacttcattcatcttcaagacatgtcttgaggctgtaagggctttcctaaacattgggagctcttcataagacagttgctactttccttaaaacagcatgccttaaataggcagtttgataaatcacctgtgcatatacttcattttagatgtgagaattgaaaaagaaaaaaattgacttcacaattctgcaccaaaagaatgagtttcacgaatgcgtcagttagaggtgctaatatagaacggttgctgagctctaaaactccactactccaccccactcccctgatagagaagtattcccagactggtttttgcctaaagccttgggtattctgaatacctctttgtgatttttttttctcttcctttttgagacagggtctcactctgtcactcaggctggagtgcagtggcgagatattggctcactgcaacctctgcctcccgggttcaagtgattctcctgcctcagcctccccaagtagctgggattacaggcacctgccaccacgcctggctaatttttgtatttttagtagagacggggtttcaccaagttggccaggctggtctcgaactcctgacctcaggtgatctgcccaccttggcctcccaaagcactgggattacaggcatgagccaccgcacccagtcctctttgtgacttttttgttggagtcattcttctgcgagctatggatatcatcaaggcaggcagtccctcaacgtggcagctgttcccacccttccctgctcctcttcttgcccaaggatgagcagaaactttacagaaaaagagagaattccctcaggaaatgaggcatgttgcttgaggtcacagggaatagaattagcaggaaaataaaccttgcaggaagcagaaagtgggccaaagcactgaggagaggacacggggagggcgtgagtttttgacagatttctctctgtaaaatgaggaggtcacccagggatcttgaaactcccttccagttccttcactctatgtcaaggattccagaaaggaaataaaataagctctgcttaaaaggcattttcaagctggggaactttgggatgaaaaagtttcccaaatgaagacatactggcacggtcagggttgagcgacttttgtgtatcaatgcacccaagcctgatgtctcattgtgggttatttccagctctgaagaagtactgcctggcagccagcatgacccactgcttctgtaattgctgcagttgcaggtgtcaacgcaaaaactccactcactcaattctcaaaatctatccaatatctctcatgccccttttcaatactataggaaatgtaaaaatgagcgacatagtcctgatccttaagagagtcataagttggtgaggaggagaaaggcatagatatagtcatggtaacacaagtcatatgtggtaagatctactgagcatggggctatcagagaaagcttcatgagggtgacatggaaagggagccctgagggactggtaaatttccatcagtgacattccagggagagaggccccaagacacaggggcagcaggtggtccactgtgctcctgccctggacagggagggcggggtcctctgctgtttgtttgcttgtgtaggaattttcccctcaaacaatgtccttgtctcccatgggagaagttttacatgagtgggaacctgtttctcttctctatcccaggccattccctgagagaagagaaaggggaatcttttttttttttggacagtttcgctctgtcgcccaggctagagcacagtggtgcaatctcaactcactgcaaccttcagctcctgggttcaagtgattctcctgcctctgtctcctgagtagctgggattacaggtgtgcaccaccatgcctggctccttttttgtaattttagtagagagggggtttttgctatgttgcgtaggctggtcttgaactccgagcctcaagccatccatctgcatgggccttccaaagtgctgggattacaggcatgagccactgtgcccagctgaaaagagaatcttaattcagttgattacttctaaaagttataagaccttcttcactgaaagagttcacatagaagctgaacttgaatccagccctcttaaatttcagttcaatattccctgcacatctgcacatctttacatgaattctcagtgatattccttcatccatccattcatgcatgaggattacagagatgaagaaagttccagctcttatcctcttgtgctcacagtttaacacgggagatgaaactgctgctgaatggctcccattctgaagtcagccaacagtgtttgccaatagcccccactgaataccccaccatattctcaagtaactcactcatttaggggaaaacaataatataattgtctctagaaattttaggtattctccactctaagattactcagtgttttgactgatctcaaggcgactccgtggtttgcttctgtcaaaaagaaaacacagttcccactgggaaatgtgtggagagtaatggttcaaaacgccagctgtacattagtgtatatccaggatgctttaaaaagtgatggccaacccctactgggaagtgaggagcccctctgcccggccagccgccccgtccgggagggaggtggggggagtcggcccccccgcccggccagccgccccgtccgggaggtggggggcgcctctgcccggccgcccctactgggaagtgaggagcccctctgcccggccaccaccccgtctgggaggtgtgcccaacagctcattgagagcgggccaggatgacaatggcggctttgtggaatggaaaggcgggaaaggtggggaaaagattgagaaatcggatggttgccgtgtctgtgtagagagaggtagacatgggagacttttcattttgttctgcactaagaaaaattcctctgccttgggatcctgttgatctgtgaccttacccccaaccctgtgctctctgaaacatgtgctgtgtccactcaggattaaatggattaagggcggtgaaaaaaaaaaaaaaaaaaaaaaaaaaaaaaaaaaagtgatggccaagactcataagatgaattaagcggactctctggggaacagaaccgaacatcacaataccttcccttccagttccttgaatacttccaaatcgcacttaggattgaaactcaccaaattagagagatggaataatgatttccatggttggtctgattcactaggaacaggtatgctcaagcagtacttctcaacctttaatgcatttagaaatcatccagggatcttgtcacggagcaaattctgactcgggaggtcaggggttaccgcctaagattctggtgcaaacaggttccacaggaggcctatgttgtgggtgcatgaaccccattttgagtaacaaggctatcaagtcagagaataaatacgcattgcttttacccacacagaacttgcgactgaaatgagaaaataggctgagtgtgatagctcatgcctgtaatacctgcactttgggaggccaaggcaggaggatcccatgagcccaggagttcaaaaccagcctgggcaacatagtgagactctgcctcttaaaaaaaaattagaaaaagggaaaaccaatctgggaaagatcaaatattgatcaaacattgcaaataatgccataaatgatcagaatagggagagtaacatgctacctggagaactagaaaaaaaattctcagagaaggtggccctgggacctcctggctctgaatggtggttctgaatatcaggagaggggctggagaatggtgttttctagtgatgctgctggagtcgtgtacatggaccgtgttccatgagtagtgagctgaccaattagagagatgaggggtttgccaggacaactacataatgagccatatttcaacatacatgaagttttgtgtgtgtgtgccaagcaaatgagtctcagattctcggacaaaaacgaatacttttgctcagacagacagcatgtgagtgcttctcccccagcttcaaccctgcagtgtctacaggtgtcattggtccccggtagacgtcctcggttcaatgggtcactgatcacttatcaccagcaccacatgaccctggatggcagccaaagagttcctgggtcttgtttccctacctccacatttttttcctgacccagcccgagccacgtgcacaccacagggctggagtcccagtgcttttgtcctgacagcccattctcccactcccacacccaaccagttccccggggggtttttgaccagcagctccgcctgcagccctcgacccggatccaggcatcctgcttaaggaggggttcaggtggcaggaaactccagggcaacaaagtgtgggtggcatgggtggggttgaccggaaggtcactgtgctgggaggaagaggaacgggtggagggaaggcaagatacggatcaggagtattgacatcctgtgccagtagaggggcctgccccatggtggaaggtgtggccggatgagctcgctggcccatgtccccccgtttcccaggctttttcctcccacgctgtatgcagtgcaagaacaagctggtgcaattggactagcagcaattgagtccttttacccaaaagaagaagaaagagcaatgtttcaaaagaataaaaaggaagctgcagccaggtgcagtggctcattcctgtaatcccagcactttggggggccaagaggggaggatccctggagcccaggagtttgagaccagcctgggcaacatagtgagaccccacctctattttttaaaatgataattaattttaaataaggaagtttgtgaaagccattggtttctttattctaaagagcgtggaaaataggacagtctccaacaggccctgatttcctttggtaagaaaatgagcaaagctatagactaggaaacatgactggttaaagccggcccatgcaccaactccgatactgatagttatgtttcctttcgttcttatttgcttcaagctttgttccagaaaacatttgaacactagctagaaccaccacagtgaatatccattgcctaaatgctatctttcaggtattatgttcagacatagtattactttggttaattctcaaaataaagtaggtcatatgattatccccattttctgcctggtgaactgtggttaaatgggcttacagagattaaatgggttgcctgatgtagcccaacgaggaaggggctaggataggaagcaggcgctctcattccagaacctgccttttttcctcctgtctaaactgctgctaaaggtcaaagacaaaggtgccatgtgagcagggaagttatttttgttttttacaaaggtgaagtaataggctgtgagtaatgcccactgctccttcagccccaggtacatgcagtgaggcggtacccacagagccgcgtggcactcctcaacctgctagagcagccggcctcctgcaggatggcttaaggaccacctggtccttggggtctgggttctccgggtcctgctgttccctgcagccttccttctacccccagagcagcttgggggcatctttagagaaagcggcagtgtcgcacctgccccagcagccacaaaacagaggaaattctgagcacctccgggcgtgagtcaccataccacattcaggaattgccacctctgcccacagaatcacccactcttttctgtttgggaccaaaatagatacctccttcagaagccgctgctttctgtactctcagcaataaaaaaacaaaggctaggataggtgtgtgcctctgaggcgtgagggggggcgcgttttctcccctgggaaggttttcagagagaagttgttgctacagcagtacaggcagctgatgggttgagggtacaggaggaagagggaaagtcagggagattggagacaacctcttgtgtggtaggacttccggctattggtttgttcattcctttgttcattcattcattcagcaaatgttcattgaggaactgctatgtgtcaggcacagggtttgagacacagagatgaataagagcccatccttgacctctgcacag

SEQ ID NO: 513 - DNA, 7020 bp, Homo sapiens
cctcagctgtaacatttgcctcaggagacccaaattcttcactgctctgctcatgtatgtgaataatcatgaaagcactgagcactgacattagggttacaaataaattttagccagtgagtgaattcacaaatacagaatctacaaataatgaggatcaaccatatgtataaatacaggccatttgctttttatcattaacactgtgaccaagatttgatgtgatctttacataaaaatattaagcaaatttccaaacctggtgtaagccaggatttctgatccccttactgctaaatgaacaaacaaaaaagagaccacacaaaatgccaaaactagaaactataaacatgcagaaaacagtgctgctggacaaagtcacgccattccacaagtggtaccactggccaagggtggacatagcatgcatttaccttcaggaacataaggaagagctgacccggtgtgaggacttcctggttcaccaaactatcaggattgtcctccatgcactctcctttggctaaagcaaagagctttcgcgtcatgagacaaagcatataaaacttttcagtattggatttcaagtggatacagatgcactggctgtgaaaacagaaaaaaaaaaaagcttaaaacaattcagttggtaatactacttaatattctattaaccaagatccccaactcatgcttacttaactttaattaaataaaattaagcattcagtttttgagctacactggccacatttgaagtgcttatcatgtgactggtggctatgcactggacagcaccagtatggagctggcttctttagtaattatacagtggttatataagacaaagtccttgctttggagaaataaagtgatacaatccctgcaactttcagggattgtacagaaagaaaaatgtacatctgtgtacacagaaagtaaaaaagtaaatgtaaatgaatgaaatgttcacaattagaatccaatgtactatttggacattattctggaagtctgaaattatttcaaaataaaagttaaaaagtactataaaataaaacacgactactaaaaaaatacaagtgaggagggccgcaaaaacaaaggtagcccccggctagcaaggaccaggattctaccccaagattcattctcattcccaaatgactcgcccgcccaaactgcaaccaatacaaagaaccactgacagccctccgcccctccaaaaacagtttagacaaagcacacatacttaaacaggaactccgcagcttgctcatttgggtaccagtcaggaacattgagttttactctgaagcattcacctaggtagttaaggacctgtttttgtgtcgaacaaccctcttccattacaatccttaacatctgagaaacagagttcctaaggaaagaatcatcctcttttcctttgatgagctcctgaaagatctgataatcagaaaagctgacaagtgcctagaatagaaaataaaaggtttaattgctcactaataactaaaatactttatctattcactaataattatcttctctcatttttttaatacccaaggaaaattagcactctgctattgctgaatcaaagtaaactctctaaaataaagcattctttgtatgatagccagacagcacaattgcctccagggtcctcatctcctggtgttcacaaacgtgtagtttcctcccatgccgaatcaaggctggcctgcttgaccaagagaatgtggtgaaaaagataatgggagactcccagggctagatcacaaagggcactgcagctttttccttctgcatcttctgctctctgttctctcagctaactatatggaggaagacagttgcctcaagcagcctacagaaagggccatgtagagagcaaccccatgaggagacctcctgccaccaaccagcagatttgccagccatgtgagtgagccaccttggaagtcctgaaaatgactgcagtcctgtctgacatctccatgcaacctcctgagaccctgggccacaagtgcccagccaaagcactcccaaactcccgacccgcagaaactgtgagacagaaatgttattgagttttaagctattgaattttgacgtaatttgttttggagcagtagacaactagtacagtattattttaacaaggagaatccatccaatgtgcacaggatactacccccagtgaatttcttcataacaaaagaatgcattcattaagtcataccttaagtgcaaatcccaaaggaagaaagaacagttcttttcggtaaataaagttcaacataacagtgccattttccaagtagtggaggttcatattgacagcggaatgttcttccctcacacagtgcattgaaactcctattgaaccaaacaacaaaaaaatcagaaactcattgatatcttaattgcttcaaccattttctttctgaacaatcttaacctcttagacacaattaaagccaaatcactaagtttagccaagactggcaatcaaaaatgtttctaaacctcagcaaatgtcctcttgcatgcaaaatctacccagattgagaaacactaatgtaaaataaccgaaactatgaatttaagcaaacttcaaagtttccctccaggacagagtccacatcttttagcactttatatctgccttaaactgtggagtctggtcaagacatggtgcttgatctaatagttccaatggagaaaagtagaattttagattttatttcagtttcaggcaaagactgctaagacatactaccatcaactgatgcaaaagaaaatcactagacattcaggcatgctgtttttctaggtatagtatgtatggctataattaaggtctgatttttagctcaactatcaggacaaattgtttaactgtcagggttgctcaagaatacaacatgctgtcttaggcattgtcaaagagaatgttccaacagaggccaggtggctgtcagacagagaccctgaggggtgtaccacagtggcctgaaccagaagacatccaaggcccacattcacctatggccaagccagactagcttccatcttcataagtagtaacaaaaatacacatgctctttcagtttgcaaaagtgcagcagcctgaaccagaagacagccaagacccacacccacttatggccaagccagactagctttcatcttcataagtagtaacaaaaatacacatgctctttcagttagcaaaagtgaattttaaaatgcttatgattgataaaaatcatatatattcaaggtgtacaataccttgaatatacatatacatatattataatgatttccacaatcaaactgatgaaaacatcaatcaccatagttatcatttgtagtacgtgtgcacgcgtgtgtggttgagacacttaaaatgtactcatcaattttaagcagtacagtattactatcatcaccaggctgtacatcagatccccagaacttattcatcttgtaactgcaagtctgtatcctctgactaacatctctccatttcttcttccatcccaattatgaaaacttaacacaagaatgctcaatagaaaaacaacaaaaaacaaaagaaagaccagacacggtggctcatgcatgtaatctcagcactttgggaggctgaggcagaaggactgcttgagcccaagagttcgagatcagcctgggcaacgtggtgaaaccccatccctaccaaaaaaaaaaaaaaaaagaaacaaaaatatcaaagaccatttggatgcatctacttcaaaaaaaaaaaaagttttaaattttccttaaaaaatattctaataatctccagaacttaccatactgagtataaccaggccctctggttttccattttggtcttatcattgcaatgggaaaatttctccgaggcataatcaacattcggatgactttttcaatgccattgattataaaatagccccccatttcctgccaaaaagatgaattgcaacttgttaaacaaagatacatgactaactgtaaacatgaacctcactcctagccaaaggtagtacaacacacagaataggaacacagaggtgaaatgtactactgatcccttgaaaacagtacacagacactgtctttgtgtgaattaacagttttctcaagtatattacaaaggtcctagggacatgggaaaaaagtatggaagaaaaacagggtacttctctttatcagacaggctcaacctatcttgcctttctgtcccctaaaatgacttcagtcttcaaataacactaaaaaaaacttactccaaagaggtgttgaaagataaaaactgggccgggcgcggtggctcacgcctgtaatcacagcactttgggaggccgagacaggagcatcacaaggtcaggagatcaagaccatcctggctaacacggtgaaaccccgtctctactaaaaatacaaaaaattagccaggcgtggtagtgggcgcctgtagtcccagctactcgggaggctgaggcaggagaatggcttgaacccaggaggcggagcttgcagtgagccaagattgcgccactgcgctccaacctgggtgagagagggagactccgtctcaaaaaaaaaaaaaaagaaagataaaaactgtaaccattttgcttccatacgagtatggtttcccaaatacgttcaaaaacttgattgtatgaaagctctggaaaccagaaatttggattagctaaatagaaaaatatttttaatagctctgctcaatatcacatttctgtaataaacagctactatttacgaattgcctactatgaaacaggcatattatagtaggtgctctatgttatcataacatttaattctcataacaatgagtggggtagctattatacccacttgcagcagaggaaactgaggctcagggagattaacttccccaaaccacaagactgataagcggaagagctgtgtgtcaaacccagatctgacaccaaaaccctcttcccaccacataacaccatctacctatttagtaggcactgtttgttcatcttgattacctcaactcaactctgcaaagccacctaatatagctgaaagaaatgatgaagggaatgcatataagtcatttaatatgcgcacagaatcttactgttagcaaagcagacatttttatttcacttttttagtgacggggtctcactctgtctcccgggctggagtgcagtggcacaatcatggctcactgtagtgaggcctcctgggctcaactgatgctcccgcctcagcctcccagttagctgggactacagatccatgccaccaccatgcccagataaatagacatttttgacaatagctttgtggattaagacagcttgaaaaaaaaaacaaattttgtggaagtatgtctctatcattcagaaaattagggaaaaacctaccagttcttccccccgaacaataatattctctaattttacagccactttttcatactgtctaatttgatagttattcagagccatacactgtatgcaggcaagatactgatatctctttcacctatccagaaattggagcacagaaagaaaacactgacacacttcttgtcttcttactcccaacccaggccttctctactgtctcatgcctggacgcccgtcattacctctgcctcctcatggtgctcaatgagggcttgtgggggaaggttacgtaagttgcaaagcttggatttcaccatgatgggaacatagccaagaaactgcttaatgattccttttgagattccattcactgcccagttgatatcagcctaaatgaaaacaagagaaaaagttacttaacagaaatatctgcatttacgagaacaaatgagtattttcaaagactgaggaagaagatcaattaaattattttatgccttagatttagaaggtgggatctcttagacaatagcaccaagaaagcaatttctggcataaactttattaggcacccgccctactcccaaatatgtgcagtgttgagagtcacacagtatcactagtactcactgtcaacttcccacggtaggtactccttcggccccggcattctgctggataaacattggcctctttgcagatggtcccttttggaactgtaggtggactgataacagcatccagaatagtaaaagagatacgctcatctttgaaagcaaattcaaagggaggtatagcctgaaatgcaattcacactattaaattgcttgcatttccaaggcattttttctctaagactcttccaaatcttatgtgttctacaaacattgatgcctgtgatgccaccatgacacacctaaaaaggacagttaaggctacctccagttggccgggcgcagtggttcacgcctgtaatctcagcactttgggaggccgaggtgggaggatcacaaggtcaggagatcgagaccatcctggctaacacggtgaaaccccatctctactaaaaatacaaaaaaaattagccaggcgtggtggtgggcgcctgtagtcccagctactcgggaggctgaggcaggagaatggcgtgaacccgggaggcagagcctgcagtgagcagagatcacgccactgcactccagcctgggcgacagagcgagactccgtctcaaaaaaaaaaaaaaaaaaaaaaaaaaaaaaaaaaagctacctccagtctactcataacttcactaaatacttaaaaccacaaagcattattagtacaagattgttttgagtgaccacatgtgtcagagactgtagtaggctctagggatacagctgtgaacagaacaaaattcctgttctctgaaccaagagccttgtgtattcttaacttgtctatgtgcatagcaagacaaatgggactactgctaatagagcaaggatacggaaacatcctttaggatttaagactagatgcttaatgtacaatggcaacgtcaaactgaagccagagccatgcaaaggaaaagat

SEQ ID NO: 514 - DNA, 6396 bp, Homo sapiens
ttacaagcatgagccactgcgcccggcctacaaagtcttaatgactggagttatcctactcttaatgtggtgtatccatctttacccaaaacctggcctacaggcagatcaacacaggtgtcgagcagcagaattatgggtacattgccagttcctgctctgacttttttcctcttctcaatctagattgcccctcccctcccctaaacctgacagcagacagatataatacaactgactgcatacctcttctgagttaaaaaccacctttctcttatgcttaacaaactgactctagttactgtaactggacctgattttgcccaaactgcatcaacctgcatttacagcaatctcttgtagcaatatcacaactttttgaacttatctgccaaaaagccacacagtgatttgtagtaaaacattacggcataatctggcagctgactgacaacctgattacatcttttaaaaattctgttgggactgggcacgcctataatcccggcactttgagaggctaaggtgggtacatcacttaagcccaggagtttgagaccagcctggccaacagggcgaaacctgtctctagaaaaattacaaaaaaattagccagccacggtggtgaatgcctataatcccaagctacctgggcagctgaggtgggaggatcacctgaggctggcaggtgaaggatgcagtgagctatgatcacaccactgcactccagcctgggtgacagaataagagaccctgtctcaaaaaattaagtaaaattttgttgggagcaaagattgggacttgtattacaaaacgtccaaaaaactcacttcttcaacaaattgtctctgtatggcacgctagaggattttccactgcagagggatgcaccatggtaaccttaaggagatgcgtgagtggtgtctttatttattttattttacttattatttttttgagacggagtctcactctgtcgcccaggctggagtgcagtggcgtgatcttggctcactgcaacctctgcctcctggtttcaagcgattctcctgcctcagcctccctagtagctgggattacacacgcccaccaccaggcccggctaattttttatatttttagtagagacagggttccaccctgttagccaggatggtctcgatctcctgacctcatgatccacccgcctcggcctcccaaagtgctgggattacaggcgtgaggcaccgtgcccagcctgttttttgtatttttagtagaggcggggtttcaccatgttggccaggctggtctcaaactcctgacctcaaatgatccacccacctcggcctccaaaagtgctaggattacaggcgtgagccaccatgcctggccggtgtctttcttttataaaagaagaaaagggccaggcgtggtggctcacgcctgtaatcccaacactttgggaggctgaggcgggtggatcacgaggtcaggagatcgagaccatcctgcctattacggtgaaaccccgcctctactaaaaacacaaaaaattagccgggcgtggtggcaggcacctgtagtcccagctactcgggaggctgaggcaggagaatggcgtgaacccgggaggcagagcttgcagtgagccaagatcgcaccactgcactccagcctgggtgatagagcgagactccgtctcaaaaaataaaataaaataaaataaaataaaatgaagaaaagaacaattgtgaaaaaatgtgagagaagagaaacctacaggccacaggcccattcttaagcagatcactcataggcaaggatacaaaataaagtcaaggatctagaagttgatttccattcaacaatctatgtgcccaaagatgttacagaaagtgtctgtgtaccccctccacatatttccatctgaagaccactgcactatagcattccggacagaaagtgggcaagcaagaggccaggaagtacaggaggagtaagaaaagaaacagacatcacggctaacacggtgaaaccccacctctagtaaaaatacaaaaattagccaggtgtggtggaaggcacctgtagtcccagctactcgggaggctgaggcaggagaatggtgtgaagcccggggcaggccgagcttgcagtgagccaaaattgtgccactgcactccagtgcagagtgagactccatctcaaaaaagaaaaaaaaaaaaaaagaacagaaacagaaaaaacattgggatttcaatgtagcatgcacggggtgggataaatatggaggggagatgagccaggcagcactgacattttgatgtggaggctaatgataagctctcaccatgtgctaagcaacttacagacattaacccttaccaccacctcatgaaacaagcaagctggagagcatcagagtgaagaggggccaatcaccatgctctcctgacttctttcagtggcagttttggcagcctgagaatccagggagatgtgtggtggaagactgaggaggcgaggcctagggaggttagtcaggacagagctgagatgactaagtgagatacggatggaaatgaaggggggctgggaggagtggggtgctaagagatggaggttacagagagggtgaaggatgtgatgagcaccttctttgtgctccaagggaaggtaaccaagggaaggtatctgggaaactgggatgaggttttattttgaaatgtcgaaattttaatacctcaaaaataatatcctttgaaactcattaaaatttatgatgagaaatggaaatgttttggatgtcaacttgcaaatgtataaagagacacaaaccttccaaaattattttacggggtatgtgagcaaaaatatttgcagtggctttgctttccttgccagagatctaacctcatccaagagctccagcaggacactccaactgagttaacccagtcaaataaatgccctaattcttgcaaggcactggttcagaaacagcaaggattcgggaattcctggtttggaaatggacatccaccttcatctgggtcaatattttgaggacgtttgctgggagcttctgggaatagtttcctgccatcctgagagaaccataggaaaatacttccatatattattgcctgtacctgctgctgccatctcactaccagcctgtggatgagggcagctaaagctcagaaaaacaagggagatgctgccagggccactggattaatcagtcctgaaaccacgatacctatttttttttttttctttggagatggagcctcgctctgtctcccaggctggagtgcaatggcgcaatcttggctcaccgcaacctccgcctcccaggctcaggcgattctcccacctcagcctcccaagcagctggtattacaggcatctgccaccacgcctggctaattttgtatttctagtagagacagggtttcaccatgttggccaggctggtctcgagctcctgacctcaggtgatccgcccacctttgcctcccaaagtgctgggattacaggcatgagccatcacgcccagctgaccccctccattttcttccctgacccccaggctctaaggcagacagctactccttcaccttgtagcagctaccccactgcattattaatttttcatacctattttcttctctagaccataagcaaggatgctgttccattcatcctggtattctgagtacctagcatatttcagatacctggtaaatgttaagtgaatttgtgtaactgtcttatatatataatgaatctgcaatacctcccttttttctgagacagggtcttggctctattgcccagactcactgcagcttcaacttcccaggctcaagaaaatcctcccacctcagcctcccaagtagctgggactacaagcatgcgccaccacacccaactacccaactaatttctttgttttttgtacagatggtgtctcactatgttgcccaggctggtcttgaactcctgtgctcaagtgatcctcccgcctaggcctcccaaaatgctgggattacaggcatgagccactgcacccagcctctgtaatactcttgatggctaactggatatttcattcatcattatatctaaagagcctaggatagtgtctgacacatagctggtgtcgataactgtttgtaaaaataagttccttttcccaatctgggtgatatttaatttatggcactgttaacctcctttcctctcttctccctctgacccacaatagggctctatctttgcagctcaaacctgtctccttttcacgaccacccctcataagccaatatcttgtctggcagcacagggcacaatctgccactagggcgttaagtttgtgacactgcccgccatttcgtcctagcggtttacttgggggtggaatgtctgagaaaaccacagctcccacgggtccccacctcggtacagaagggagtgtccctgcttctcccacccccacggctgacaggcaccaaaccagagctgggactgtccctggcggtgtccaggccccaccctctctgtgtgcaggtggaaatgaaggcctgggggcggggggaatggagggaggcataaacttcaaggtcacacagcgaaccccggtcagaacgggcctaaacgtagggtttccgctcggctctctagggagctgggagcccagcccccgcctacccccacagccgcgacggaatgaggtctcaccgcaggccgctactgccccgcgctcgctcactccgctgaggctccgcgctgctgggccgctcgcacagagcccgcagctgttgtcccggtgtcactggcgacgggcatcggccacttccggtacccgggcggcactccagccaatcggcgcgcgtcgcactccgctggaggaacaggtggtcagcgcaccgacgcccccttgccttttccggcttgcttttcgccggttctagccctagcccaagttccacgtcgccgccgcctgccgagccggctccctggaacagcaaagtgcacccgtcgatgcccacttcagccccggaatcattgacgacctgagtcctccgggtttcctagaacggctccggggatgaacttccgctccgcgatctgccgctctgcgccctcgtgtcgctccccaagcattgctctaggctcaagaactcgagaatccgcttcgcattcccgcggggaccgtttgcgcgacccttttaactctcccaacccgcatcgttcttatcccatccttcctttccacagactccgtgggtctgataagcacagggctgcagatcctgggaacaggtctctcctcggcgggagcgaagggagacatgctttgagttccggaagggcttgcaggagtgacgtttggcctgaaatctcaagattgcgtgggaattaccaaggttaagagtaaaggcctaggttaagctgccgaggccacggaaacagcattctgcagctagccttcctgggttccctgagcaagcttggcccattctcacctcagaacctttccttgttacttcctctgtaattttgcacagccagcttgttttcttgtttgtttgttttttgagatggagtttcgctcttgttgtccaggctggagtgcgatggcgccatctccgctcaccgcaacctccgcctcccggattcaagcgattctcctacttcagcctccccgagtaactgggattacaagcatgtgccaccacgcccggctaattttgtattttaggtagagacgggttttctccattttggtcaggctggtctcgaactcccgacctcaggtgatccggccgcctcggcctcccaaagtgctgggattacagacatgagccaccgcgcccggcctccagcttgtttttgtttgttttttgaggcggagtttcgctcttgtcgccaaggctggagtgcaatggcacgatctctgctcactgcaacctccacctcccgggttcaagcgattctccagcctcagcctccagagtagctgggattacaagtgccagccaccacgcccggctaatttttgtatttttagtagagacggggtttcaccatgttggtcaggctggtctcgaacttctgaccttaggtcagaccttaggcccaccttggcctcccaaagtgctgggattacaggcgtgagctaccgcgtccagccagccagtttgtttttaggtgtcagttccaagatcaccacattgaagactttcattctatataatgttgcctcagagtacactatccttcccaaatatcagttacaaaggactatgattagccctgtttgggtctggtgctcaaccatggaccaatcaagggggaaaggaccgtgtgatttaccaagcctggtcacctgccttcccgcaagga

SEQ ID NO: 515 - DNA, 4892 bp, Homo sapiens
ggccggccgggccgccagcccctgtctgggccgctgtcctttgggccctggcggcctcagccgctcgctgtccgggtgcggcggcggccgcggcggcggtggcgggtgagggcgcgtgtgtgtgagcgcgcccggagccactgcagcatctctgcatcaagatgtgctcctccctctcccaggctccgctcactggctggctctggtcctcagccaacgctcgggggccctggagatggcttccttctgcccccctcccaccccacttccgtccccaccctcctggctttacctcatttgctgtcatttaaggaccagggagcgagcccagcgcgcgtcttccataatgcatgggccgctcatggacaggccgcggggcgctgtctggcccgcctgccctcccgatcctgcccagccccacttctagtccccctgcccagggctgaaggggcaggagaggggcggggtgaagagggaaaagaaagtggctcttactcctcaaaccctggagacccatggagccaaaactcctggtttccccagaaatcccctatccgaggaagagatccaaatcagaaatcccagcttgctgtgtggggcaagtggcagggaggggctgtctctgttgcccggtccaccccatgttcctctttattgtttcccttgttcaaaagtagtttgagctttttgtcaaaatatctaaatattagaggacatttaaaaatacatagtgaaagtccctcaaccactactcttaataaatctaagtacatgcccccaggtttattattttcgtgtatacaattacatgggttagtagggttatttcacacaaatgtgattacataaaacagtaggattggccaaagacttttaactgtgtaactgatcttggacacttttacgcatcagtacgtttggatccaatcccatttttaagcaaccagcagtgtgatgtcatgaaaagctccctggattaggggtctgggtgtctgaagcatactctgggctccacaaccgactggctgtgtgtgcttggctaggtgccctgccctctctgagcctcgctggtacctgaagggattaaagatggacacagtcctgccagctctgagattctaagtgctcacccttgtcagcgatgcctttctcctgccctgctccggtcacgtgggggagtgcccaggaaggctgtggcccggaggcggagggaccagccatctgcggcaccagtcggccctgtcaggctgtcactgttgtctcacccccctctgatctgcctgctgtccagcttgcacaggcaagaccggtgagcagtccagatgctgcaacagctggcagggccaggccagcctcccagttttaaatggctatacctgtcaagcctggatcatggctccatgtctccctgagtggaggaggtcctggggacctgggccagaatgagagggtctggaaaaggagaaggagtcggggaggttctgctgctcagcctccaaggctggaatgtctgcccaggtcccacatgcgctcccctcctttccttctgagcccctccaaagggcttgcccaacttgagagatagtcttctttgttcctgatggggaggacttggattttgctaatgatgtttcttaaataatgttgaatgctgttatatagacagacacatcaaccccttgccaggatatctttcccttccttcccctgcccacactgtccttgcctatctgtatgtctgagggctggcacattggctctgagctcctgaggtgaaccttgctctttggcaccattcaagtcagcctgggctccaaagagaggctctgcaagttctctcctagcagaaaacggcaggaacaagtccttgccaagaaaaggatgctatgtctgctgcagggggctgacgggccaggaaataggctggcccaggaaccaacagtctggaaatgcttgcaaggattgctttagacggagacagctgtctttgtgactctattttaggacagctgctgccctgtggtgggagctgggtctctggggagggtcgttagcacaggtgacttgggtcttaaagactctcagatctcaatgcaaccagcatgctccatgtggactctggcagacacaataagtgaaaacaagaacatttgccaagcctagacttggatggggagacagttcccaaagtctcatcttctcacttgtctgaagctctcagtgaagtctagtatgaatgagtttggggagattagggggatctgcactcccagtctctgagatgctcctgttcctgaggagagagtggggtgggcatttgggggtgcaggctgagttttgcttgtggggcccattagcttgataataacagaaataatatctgttttgaatgcctcccacatgccgggagctgtgctaaatgctttacctgaattacttgcgcaagaggtccatgttgttattatcctcacttttcagatgttgctcagtaagagtaaggaacttgctcaaaagaaatagtaaacaagtggaaccctgggcaacgtggcgaaaccccgtctcaacaaaaaacacacaaaaattagccagtgtggcagtgcacacctgtagtcccagctacctaggaggctgaggtagaaagatcacctgagcctgggaggttaagcctgcagtgagctgtgatcgtgccactgcactccagcctagatgacagagtgaggcctgggatcggcctccagcatcctggcttagccaccgtgccatggactccagctacctactgtctgttcttttgaggtgggcaaaatagggggcagaacagtttcttcttctttggtgacatccagagcccacaatcttcagtgcagctgaccataagggccacctctcctttctgtggctgatcaatatgactccatgttgtccagagctgggactccacatctcaaagttgagtccccacagactttcaaacagggcaagaaagggccagtgaagataatcaggtggctagtcaaatggcttataaatttgtccgcaaacatgtggtgctcccttggtggtggtgggtggggatcagaaagcattttgagggccacccaaccctgcccagaccatctgcttcttcctactgtagccacacaagattgatagcaatggaatccagtgggtctctaaccgatcaagaagggacctctaggccccatccctggggacaagtggggaggagatgagaccctgccatggccccaggatgctgcagctttgctgtctctttcctcaccactcccccgcctcacctctcctttcctggcctctcccgccaccagcatctttgcccagacccttttcccaggaggccatgtatttatggagcagctcctctgcctggaatgtagggatccaagagccaggggatgcggtcttcaaagtgccagtgacctttttggaagcagtgtgacagtggtaacaggactgtccatccacagctctggggaaaactgatatggccataaggaaaagctctgcagacagacccgtttgacacccagtcctgctactgaggagatgtgaggccatgggcaagccacatacctcttcacccagaatatggggatgaagacacatacctcactgagttgatgtgagtgttgagttacacgtgaagtagctagcacagcaggtgctcaataaatgtcagtatttcccttttgggatttagcctccctcatctgtaaaacaaggatatgaggcagagcagtaagggctgcaagtggttggggtggctctggatttgtagtcaagagaactggactctgtcccagctctgtcactcctacctggatgactctgggcaagtaacagaatgacacttaatcgcccagataatccatttcttcaccagtaaaataggaatgatcctactcctatctaggatggtagtgaggatatgtgaattaaacataatggtttttaaaagcactttgaattgcaaagtgccatatcaaatactgatggccattccctcagctatgcagtccaaaaggtagggattatctcatcagtccgtattctcccagtcccccaccctcctgtttagcacagtgcctggtgcatggtggagactcaataaatatttgttgactgggtgaatgaatgaaggagagtagctatagtaaccattcagaggatgaggagagagggaggtaggatgtgggtgaagctttcagtgggggtgggtgggtgcatcttgaattgagcctggatggacagagaggaggtggggaatgtgtttctggcatgggggcatgtggtgtggcaggagccaagatgtggggcctgggaaggccatgatttgtgtaatgcctggagaagccaagttgacctagcaggggtgctggaaggaagatctcaatgccctgtctgcatttgccttcctaatttcatgtgagggcccagaggggtctgtggcctggaggggcctaattattctctttgccatttcaacccagggctcttgcagctcctttttcaggcttataatagatgatgctaatgtcattattaatatttaatagtaatgatgctaataatgccctgcatttatgtggtctctccaaagagctcaaagaaccctgagttctttttttatgaaacaatttggctggtgtggaaggtgggagggcaggagggcaggacagtagagagggattgagtcacaaagaaagcaaagccagaaaggtgaaatgattgggccaaggtcacagagcagtggaggtggggctgggctaggactgggtgcgtgggttccctgcctggagctctgtccttgactgccccaggtcatctgggtttaaggaggacgttcctggtggggacatcttttggtcccg

SEQ ID NO: 516 - DNA, 7473 bp, Homo sapiens
ggcatgcgccactacacctggctaattcttttttgttgttgttttttgtttttgttttgttttgttttttcagatggagtcctgctctgtcaccaggctggagtgcagtgacgcagtctctgctcactgcagcctccgcttctgggttcaagctattcttctgcctcagcctcccaagtagctgggattacaggcacccaccaccacacctggctaatttttgtatttgttatggagacgaggtttcgccatgttggccaggctggtctccaacttctaaactcaggtgatccaccggccttggcctcccagagtgctgggattacaggcatgagccaccgtgcccagcctcttttccgtttttgttttttttttttcctttggttgtctggtttggtttttattatagcctttctagtgagtgtgaagtggtatctcactgtggttttgatttgcatgtccctggtgactaatgatgctgagcatcttttcatgtccttattgaccgtacatatagttctttgagaaatgtcttctcagatcctttgcccatttttaaatgggattgtctttttttattaaagagccagagatctgaagtctttttgagttgtaagatttcttcatatattctagacagaagtcccttataagatacatgatttgcaaatattttctcccattctgtgttgtctttttacttttttgatattgtcttttggtacggaaagacacttattttgatgaagtccaatttatctattttttgtttggttgcttgtgcttctggtaacatatctaagtgggagccaggtgcagtggctcatgcctgtaatcccagcactttgggaggccaaggcgggaggtttgcttgagaccaggagttcaagaccagcatgagcaacattgcaaggttctatctctataaaaaattaaaataatgataaaaggaggccgggcgtggtggctcatgcctataatcccagcattctgggaggcaggaggacaacttgggccaggagttcaagaccagtctgggcatcatggcaaaaaaagaaaaaagaaaaaattatcctggcaaggtatgcctgtagtcccagctacttgggaggctgaggcgggagaattgcttgagcccgagaggtggaggttgtagtgagctgagattgaaccattgcactccagcctgggtgacaggaatgaaaccctgtctcaaaaaataaaaataaaataagccaggtgtagtgctgcgtgcctgtactcccagctactctggaggctgaagtgggaggatcacttgagcctaggaattcgaggctgcagtgagctatgatcataccactgcaccccaatgtgggcacagagcaagaccctatctcttaaaaaacaaacaaagaggggcggggtgcagtggctcacgcctgtaatcccagcactttgggaggctgaggcgggcagatcacgaggtcaggagatcgagaccatcctgcctaacacggtgaaaccccatctcctttttttttttttttttttttgaaacagagtttcattctttttgcccagactcccgggttcaagcgattctcctgcctcagcctcctgagtagcggggattacaagggtgtgccaccacacccagctaattttttatatttttaatagaggcggggtttcaccgtgttggccaggctggcctcaaactcctgacctcaagtgatccgcccacctcggcctcccaaagtgctgggattacaggcgtgaaccagcgcgcccagcctcctacattttcttctaagagttttatagttttagctcttacatttagatcttgttttcattttgaattaacttttttgcaggtggtgtgatacagcagtctgtgcagaaaaaagttaacatagtagaccctaactgctaactttatttttacttttattttttattttgtttagagacagggtttttgtcacccaggatggagtgaagtggcgtgatcatagctcaccgtaaccttgaactcctgggctcctctgcctcagcctcccaattagccaccacacccagctaccttttgtacatttttttggtagagacggtgtctcactatgttgcccagtctggtctcaaactcctcagctcaaatgatctgcccaccttgacctccagagatactgggattacaggcgtgggccactgcaccagacccaggtttattcttacaccaatacaacactgtcttaattactatagctttgtagtgagcttttgaaaataggaaatgtgaatcctccaactttttttttttggagacggagtctcgctctgttgctcagactggagtgcagtggcactatctcagctcactgcaaactccatcttccaggttcaagtgattctcctgcctcagcctaccaagtatctgggactacaggcaggtgccaccatgcacagattccttggacatccctgagaggtcaatcatgaaggtcaacttggttttctccccctcatttgggttcagaatttaaagtccacacacacaggcagtaagatgattatagataaggacatcatcactcggtttcggatgttaaattgtctaggtgggttaggggtgatttgagatcacacaaccttgtgccacaaagaggaattcccaggccagagggagacattttattgccatgttatgatcttatcattgagttgaaaggcaatcttgtttcattttggattctttcttatgtttatgtcttataagggcactttgaatttccaagcaaataataattttgaattagcttttaatcattgacttctagcacagttatatgatcagaaacgtgctgtgtgatttgattgctctcaaatatattgagatttgctggaacaaaataagtcaggttaatttttgtaaatgtaccatgcttgcttaaaatgaatgtatctacatttgttcctgagatacgggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcgcccagaagcagggacagggagctggttggggaggaccagaaatcaggtttgtgaaggttccagagaggacctgtccttgcgaggagtgtgggagactgagatgggggaggggtcattggaatgatgcgggcgctacttggcattgtccattgtgaggcaccaccggggtcatcagggattggtggagagggagtataaagccccaggtttgctaagggagggcccagaccgaagaaggtttggcggatagcagaacctttttgtctccctctaattgctcctaagcctcacgctcccttgccccgcgtgtcctgttgcttccctgatcttctccgtgacctgtagctaaaccttccaccagcgcttgagaacttaatttgaaccggatcctttcccagacccctttcttcttctcctcctccacctcctccaggtgcccaacagcccccttctcctcctttcccttcccttacttccccccttcccctccccttcccctccccctcccctccccttcccctccccttccccttcccctccccctccccttcccctccccctccccttcccctccccctcccctcccccgccccaactcagatccggccccggtccccgtccccttccctcccccctgccctaagccacctccacctctgtcctggccgcctcagggcaccctgaaaggatcaggacatgcggctgcgcttttggctcctcatttggctcctgctgggatttatcagccatcagcccacccctgtgagtagacgctggacccgcggggtttcttcctttttactgggctgtgtcacgcggcatgaaattacacagctcaggcctgtaatcccagcactttagggggccgaggtgggcagatcacttgagtccaggagttgaagactagccagggcatcatggcgaaaccccatctctacaaaaaattccaaaaaagattagtcgggcctggtggtgcgtacctgttatcccagttactggagaggctgaggtgggaggatcgcttgggccgaggagctggacgttgcagtgagctgagatggccccgctgcactcttgtctctaacaaacaaaatggaccaaaacaaagtgaaatgtcatttgatttgtgtcatctggtttgatgacttttttttttttttttttagacagagtctcactctgtcgcccaggctggagtgcagtggcaagatctcggctcactgcaacctccgcttccggggttcaagcaattgtcctgcctcagcctcctgagtagctcagattacaacgcctggctaatttttgtatttttagtagagacggggtttcaccatgttcgccaggatagtctccatctcttgacctcgtgatccgcctgcctcggcctcccagtgccgggattacaggcgtgagccaccgcgcctggccaaaatatataaccttaagtgtaagtttactaactttggaaagtacatacaccagcataaaccgaccccctttcaagatctacattattttatttatttatttatttttttgagacagtttctcccttgttgcccaggctggagtgcaatggggcaatatcagctcaccgcaacctctgcttcccaggtttgagcgattctcctgcctcagcctcccgggtggctgggattacagacatgtgccaccactcccagctaattttgtatttttagtagagatagggtttctccatgttggtcaggctggttttgaactcccgacctcaggtgatccgcccgcctcggcctcccaaagtgttgggattacaggcgtgaaccaccgtgcccagccaagatctacactattatgtcaccccagaaagtgaactctcagtcttcccagccagtctctttcttatcataggttagcttgcttattctggaatttcgcgtatacagatgcgtgccatgccataggtactcttttgtgtctgctttgttctgctcaacaccatgtttctgaaatcattaccattgttgtatggttctctaactccatcatttccatttcagactcagcatatgctgagttcaacctgttgaagggctatctctgtttaattcaccatcttgaaagaaacatttaaaattgagatgttttcaagaatatatagttaaatcctgaggaatcgatgtagaaatgttatcacaagctgtctgaacttactcaggggaagtcttcgtcttcactcacataagagtctactggaattaatatcaacaatcttagagaaatcccacactattcatgccattttcatgatctccaccttggtaattttttttttttttttttttttttgagacagagtctcactctgtcacccaggctgaagtgcagtggtgcgatctcggctcactgcaacctctgcctcctgggttcaagtgattcttctgcctcagcctcccaagtagctggaactgtaggcacgtgccaccatgccctgctaattttttgtaattttagtagagatgggtttcaccgtgttagctaggatggtctcaatctcctgatctcgtggtccacccacctcggcttcccaaagtgctgagattgcaggcgtgagccaccacacccggcccaccttgttaatttttaagcactaaaatttgatacttatttgtgaatgaagtaatctcttcattgtattttttttttttacttatgctgagcttcaaatgacaaagattcatataatccaagagagaagtattatttagagggattcttttaccatgtgatatataataaatgcatccaatgttatacatcaatttaaaaaacaagtaaataactttaaagaaaagataactactggccaggtgcagtggctcacacctgtattcccagcactttgggaggccgaggcaggtggatcaagaggtcacgagttggagaccagcctggccaagatggtgaaaccctgtttctactcaaaatacaaaaattagccgagtgcggtggcaggcgcctgtaatcccagttactcagtagctgaggcaggagaatcgcttgaacccgggaggcggaggttgcagtgagctgagatcatgccactgcaatctagcctgggtgacagagcaagactttgtctccaaacaaaaagaaaagataattactttatacttagcttgtcttagccatgagtgacgggctgcatgtggcccaggacagttttgaatgcagttcaacacaaatttgtaaactttcttaaaacattaggagattttggccaggtacagtggctcatgcctgtaatcccagcactttgggaggctgaggcgggcagattacctgaggtcaggagttcgagaccaccctggccaacatggcaaaatcccatctccacaaaaaatacaaaaatttgctgagtgcattgtcaggcacctgtactcccagctactcaggaggctgaggcaggagaatcacttgaacctgagaggcagaggttgcagtgagccgagagcacgccactgcactccagcctgggtgacagagtgagaccccatctcaaaaacaaaacaccaaacaaaaacaaaaacaaaaaaaaatggctgggcacggtggctcacacctgtaatcccagcactttgggaggccgaggcaggcagatcgcctgccaggagttcaaggccagactggccaacatggtgaaacctcatctctactaaaaatacaaaaatgagtcgggcatggtggcagagacctgtaatctcagctactcgggaggctgagggaggagaatggcttgagcccaggagctggaggttgcagtgagccgagattgcaccactgcactccagcctgggcgactgagtggagcggaactctgtctccaaaaaaaaaaaaaaaagagtttttttttagatcatcagctattgttagtgttagtgtatgttatgtgtggctcaagacaactttgtttcttttaatataggcagggaagtgaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcggtgtcattgaccttttcattatttcaactattattattccaggttatcaatagtctggctgtctatcgtcatcgtgagactg

SEQ ID NO: 517 - DNA, 2017 bp, Homo sapiens
taaaatgcaaagcctagtgtcttctagctttttgaagagcttttgtccattatataatctgtcaagtagccaagagttcctcagaagcaggacatcatttagatttaaaacaattatggcttgtctgtaaaataatgttgtagcataaccattcatgggatggcagctacgattttacttcagtaaaatatccttggatactaccgccattttatttaccttaaagattttaccaaggtaccctagaacaaaaatggtgaggtcattttgattctgctaaagttggtatgactggaaagccaaatgacacagttatgagcatagaccttttattttccagatgtttgacagtgtaaacatacataaaatacatattaaagtttagatgctttatattttgtgcaataaattgaagccttaaaacatttcattttttttataaaagaaactcattagtttacttaattaagacagtaaaatagcagcaagtaccaagacattgtgcatttcttttatttaagacaagttacttcatttacatcagagttagaaatgttaagactggctttcttgaatacttaaatatagctcgaatcactggttagatatggacatattttcccaactgtacatcagggaggagtgctttcattagtttcagaaaatgcagaccctcagacagccagcatgaccacaacattgagcaataagagaaatgaagcatttactttccaagcatttgccacagaaggtaatggagtctttacatttgtggttgtctcttccctccataagttaagggttgtgctttgttgaggcatttcagagaaattatttggcatgccactagtgatacttagggtcatgggtgttggggatgattttgttgagctagtgaggcttgtgtttgtgaccattccatcttggagatgaatagttagagttgcagctgctgcttcatgtgaattgatagtctctgtggatgtatcttctggatagggcacaaaagccttatcagtgctagtaaaggtggtgtctttgcttagagtggcaccaaacgttgtttcctttgttcgatattgtttgggtattttggtcactttgggttgagttaccacactcagagagttaatggtgtccactgtctgcatcccacttacagtgaataagcttgaggtaaatccagaaggtgtgggatacatgttatgttcctttaaagatgatatttgggtagaacatggagtccctatcacatgggcttttgtttccatcatccacttcagtaagtaagtaatgttttgtttgtggtcacatgaccacctgttattgtaaagggttatctcttgcaactgaaagagttggtcaaaagattggtctggaatgaatgtgaacttattgttgtgcaggtaaagatgtgtgagatttgtcaggtttattaatgtacctggaagaatttgtgtcaaagaattattagacaggtccacgatatgtagtttggagggcatgttggttggaactgtccaaagtttgttactactgaggttgagaacctcgagacttcttagtgtatttttaatgaggacaaccttttccagcatgttcttagaaacatccagatatttaagattccactgataagcagtatcagatttgtcaagaagtttaatgttgttgttagcagcagacatgttccacagagaccgaggtaagtgagcaggcaggctttcaagcctgttgtttgaaatgtccagggtcctcagattggtatattgggttaactggttatgcagatcagtaaagtggttataagacaggtttaaatgtataatattctcttgcagtccagatggtaatgtagacaagtttctgcctgaacagtccacatgcctgtgcctctctgtgcatatacattggagaggacaaatgcataaaataccaggtgtgagaaacagaaggatgaacaggcagagagacattttcaatatctgatattccatcaaagcctagaaacaaacag

SEQ ID NO: 518 - DNA, 93494 bp, Homo sapiens
aacataatctctttactccagtgaacatttcagattcctctagcttcaatgaaaatatcaatatccaattcaaagcactctctcaatgtccaggacgggtcttttaaaacaaatccacacagccctttccatacttctgaataaaatgaactttcctgactttcctcacatgcacacttctgctcatttcagcaggattccaaagcagagagacagcatccggaatgcctgagatcttcgggtgaacggaagaggtgcttcagaatgtttaagacccttggctctgctactgccgtacgaacttcttacggaggagacctgatcaaagtcaaacaaaccttgattttacaggaacactgcaacgtttttaagtagccatatctttacatatttaaatattatttaagtaaccatcataaacatattcaaataattagatttatttgaaagtctgctgtatgttgatcagtataattccttggagagtgacaaatatttcaaatatattgccacaatatcattgtaaaagtttaactaaaggaatttggccctttttattaccctgaacaagaatgtgcaaaacaaagatgcaatggactgtatatatcttaactgttgctgagtaaacttaccaataaaagccaatagcaatatctccagatcattgacaagaaagagttccttgcaatatctttatatattagccttattgaatgatggttacataaatataaattgtaagaatgtttttattgaaaggaaaacttacagggcatttaaattatatttatataatttatatacatttatatttataaatttaaatttatacaatttatatacaaatttttaactttggatgtttgtgatttttctgtctctttttcttgggggggagtggggacctaaaccctatggagatgtataatgatttaaaaaaataaaaacatgaatgtaaactgtgtatcactgaaatgacgtattttactacagaactataccttctatggcttccactaaaaatataggatacattggtctatcggtcagagttttgaattttttttttcaatcattggtttataaatagcatccatcttgctttccatcacaatcatgcctgagtgagtgtagaaaaagttgcattcaggaatatggtaaaatgttacaggaagatttatgccattttgaatggattgtttcaggttgcctgaatttttaatacccctttcttgtcacagagaagagaactttgttatttttggctttcattagagttctcacttcagagttggttagtatgggtttctgctttccaagctgacatctcttttctatttagcatctgttacataaacagggtgaatagctacacggttccaaaattgtgagtgaagcagctaacccccttcttcctcactagccaacataactgacagcacttagctctctccatccctgctgtcttagctctgaagggactccgtagcactgcctgcctgactccgcgccactgacggcaggcagtgttgttgggaagagagcaaaggcagggagtctggtggtgtgacgatgaagataataaaggaaattattaatgcgtctacagtattttttgcatatttatcttactgatcctcacaccatccctctgagaaacatgttattattattacctcacatttttagtattctgtgtacatatttttaagttctatgtacatatttgtaaaaaaaatttaagtaaagcaggagagaagaaatactctagataggagaatttttttttccactcttttgcagacagtgttaaggcaggggttgggcaaatcaaaatgccttaaacacagaggaaaatatttatcttacgcaacaagaagcttaacataggcagtccagggcacaatgatgtcctcagtactaagcactagctgtcatatttctgctctgctgtcctcatagggcactgattcatcctcagcttgggtgttcatagtcataagttggctgctgctcttcgggggtcgcagtcacgttgtcacataacacaggttctagcacaggctcttgaagatagcaaagaccaaagaagtcttgtgtgtcaaattgaactgcaccacctctgagttccagggttggtttaattctctggctccacatagaagcaagatggctctagtctttcctgccactcagatgcaagcacatcataaaacaaatgaacaaacaaatcaaaaattccatgaggctcagagactttaaataatttgttcctggattttgaggcatgtatggaatatggtgccccttgttctgtctccaagtacggtgctctgccgtgaaaggtgtttgggttaagagaaggcagctctctcaggtatctgccgatttgcacaggcttctttgtacacaataggcactcagcatccactgatttgattttaggcttaaaaatgaaattaaaatggagctaccttgggctgtttggctttgttctctctctggcattttcctgtgttaagtttaattgcatttgaaccagactccactgttctggttcaggacaatgtccagaacccagacagctttttctgatctgtttaactctctgctaacatccacacagatggagaaaatcagaatcagtggactcattctattgtttcaggatcctggaccccctctgtaatcagccaattcatctaccctttttgagcacctccacagtactactccattctagctgcttcaaagtatacaagatgtagtgctttttgtccatgtacttacagtgtatttggagaaacatgtcaagtacatgtgaacaatttgctaactaacaattttaaggtgcattatatgcatcagataaataagctctatgggaagtccagtgcacaaatagacataagatgtgggctggcccttggcagatgaaccggtcacaagaagctctactcaaattttatgaacatggggtttctcagatacctgcctgctgcaccacctggtgagaatggaattgaggcaaacctagggcctggaaaattagggcaattgcttagggctatgaactctatgcagtgggagagcgattcagagagtcagtcttgaggggcaaaggaggatttctatttaggtagatttaactaagacataaagtttgagggatattttcaaacaaagaatcaaccagtatatgtactcattatgcccaacacagagcccccctcaggcaacacagccctctttgtgacttaattaataaacctgattttacttgcctataaatcttaccaggagtagggggtcattggacttgacagcaagaattttctgttttgttactgtttctgcacagcctctgaagcttggattagaaagagaggtgccgatttggaagtcaacaacacagaggtggctattaacaccagaagagtagatgagccatgaaggcaagaaattccatacagaggggaaggctagagatagaacctagaggatcgccaaccacagttcctcttaaccacagacatgactgtggtctttgatgcttcatttgtagagtaaggacaatgatagtatctaccccatagagctatttgaaggtttagtgagttaataaatgcaaagcactggacaattgcttcatagatagacaacactcaatactgttatcaagatgaatcaaattctcactccccctctcccattctcctctctctgcacttttctcctgtgcccatgaaactgccctcctgcctgtaaaccttcgccggatgtttagaaccctctgccaaacatttcttgagtgatgggtggacctccaggcctttttctttactttccacaatcaaaatttaactgtttcattttaaattccaccaactctaccatgggtgttagcattttaaccagacaatgccttcatgtgaaagaatgtctgtattgctgagattttggtctctaacagtgatttctagatacagggctctctttgtacaccctcctcaaaacacacttgtaagcaacctcctactcgtgagacctcgaaagtgggaaaggagacagcagtaaggacgatacagaaataggcacagagaaaccagcaggtaccaaggatgtcatcaagcaatttccacagaaagcaagcatggattaaaagagagaagccaacaaatttgtggtcatttgaagcctaaagacacattttaaaacatttcttaatttctttaagtttctatcttttttcctcctatggaagaaatctacccaatataacataaaccactaatactgttctctaggcagaacatagttccgtgagccaatgcaggctggtttcagggaaactaacaacattattgattttagtcaggcttattagaatcagtgttacatgcccttttcctctaccagattgtatttggacttcattatgaaatctcattacattaagaggaggctgcgatgagttctgtaaataaaaaatttccaaagatggatttgttaaaattagtatatctgtgaaatctgctttgggtatcaatctgtcaagaaagggaatcatatattttctgattagaccttgctttttaaaaaatattgggaatattcaccaattctagcagcatacaggaaagcttcccttgttttcctgttaggaactcctgtgcaacatattgtcacagaacctgggtgagacatcgcatcacataatgattacagacagcttgaagggatgaacatggctttttcctctccatgcagctcagtaacacaataggctcgtgaatcccaaactgagagctatgaaaatggagtcaagtctgtagctggcaatgcctgggatttttagtgcaggaatacggaggactaaaagagattcgaaacacccaacccttccatttctgcttcaatatgtggcgtatcatttggattaggcaacttaagtgaattgataaaattgatgaaaatgaactgatagaggaaattacttttccaaaacaaacaattgcaatatgtacttttctcttagacactcactcctgtgtctgtttattcagtatctgcacgcacaaccttgtaaatactgaagaaaatgatgaaaactgtttagtcagacagcttagtgctttctcgtccaaaattataaccacaaactcaacaccaaaccaagtagtgtggtttcactgagaactgagagagcagttgtgggattttcatttaagaggcagggaatgataaggcattagagtgaacaagtgctgtcgcaaacctcttccctgcatctctctatctgctgccctggtagaaccctgtatccccttgatcccagaatgcttccctccctccctcccacccaggtgacatttaagacctctcttgttagcccagtgctgtggcttatgcctgtaatcccagcactttgggaggccgaggcaggtagatcacctcaggtcaagagttcgagaccagcctgaccaacatggcgaaaccctgtctctattaaaaatacaaaaaattggctgggtgtggtggttcacacctgtaatcccagaactttgggaggctgagacgggtggattacctgaggtcaggagttcaagaccagcctgacttacaaggtgaaaccccatctctacttaaaaaaaaaaatagcaagaattaactgggtatggcagtggacgcctgtaatcccagctgctcaggaggctgaggcaggagaattgctttaacccaggaggcagaggttgcagtgagccaagatcgtgccactgcactccagtgggggcaacaaaagcaaagctccatctcaaaaaaaaaaaaaaaaaaaaaagatccaggtgtggtggcaggcgcctgtaatctcagctacttgggatgctgaggcaggagaattgcttgaaccctgcagaagttgcagtaagctaatcacaccactgcactccagcctgggcaacagagtgaggctctgtctcaaacaaaaacaaaaacaaaaccaaacacaaacaaacaaaaaaacctctcttgttcagggcattgttacaatttattggattcattctgataagggagaaagacctaagcatggagatacagagtagaatattacagtgtgggagagtcacacagacaggttgggagaactctcaggactcagatctcctggtgcagggtaggagttgcagtgacaggttgatttctcccatctcttccgacatgggtttccccatgtgccactccctgtagattagtagtggggtcacgaatatactcaaaccacactagcatgctgggacaatgtgtgtctttgtgttctgtaattgatctgagtctcctttatgagccccctctctcctgaatacttcaagttgccagttagcaagatatcagtcacctctgctttaaccagtctcacttcagcctctggttcatccatctggcctcttcccagggctgcctctgtgctactgatcctgcaccatggggaattggcttggttccaaaggctgaggatgtcctagggacctggagtctcaaatagcatgctggcacttgtcccagcattcctgagttccccgatgactgtaagttttaagttatcatcccctcttgggatatgactccatgacaggaagggggcagagaaggagagttgtctgcatatctagatgcacttgcactctctacctttgcttcttttcttcctgctatgcctcactgctggaaatattgggcttttattttactcattcgtcctatttgatagggacttttcctatatcctgcattctccttgtagaccccagcatcataacctcattcccagtgatattttttggatatttgtcccctttatatctcacgttgaattataatcctcagtgctggaggtgaggccttgtgggagatgtttggatcatgggagcaggtccctcatggcttggtggtgtctttgtgatccagaactctggatcttgaagatagtgagttctgacaatctggtcatttgaaagtgtgtggcatctccccctgcactctctctctcacttgttcctccttttgccatgtaaagtacctgctattgcttcaccttccattttgattgcaagctccctgaggctttgccagaagctgaactaatgccagcactgtttcctttcaagcctgcagaactgtgagccaattaaatctcttttctttataaattacccagtctcaggtatttctttataacaatgtaagaacagcctaatacatccgaacatcattaagatttaaagagagaaaccaattcaccagtagaagattataattcagcaggtatttcaaggacattaaactcattgtccattatgattttcgtaggggtgaaacttgaatggaattataaaatataggggctttgtctttcccatacaagccttcttcaggatacagttggccccctgtatcttcaggttctgaaccaaaattggtgaataataagagccaactaaagaacttgagcatctgcagatttcagtgtcttcatgggtcctggaaccaattctccatgaataccaaaggaccgtggtattcattttccaagacagaatggagatgtctattgccctagatttcatattgttcagccagatatcttgacatcattagaatgtcttaaaattctttaagccagatggacatttactttcgtttaagtcatcacagtatacttgaaaaagtgtgcatgaaatggtaacatgaactataaagggttatcagttcgattgtcatcagcgcgcatttatatttataaaattctcttgcagtggttcattatagccctgaaaagcaaggaagttcctcattactagtttatagagttatatgcacagaggcatgaggttatgaaattagttatctaagcttctacaaaggggagaaatctccttctacttaacactagtcaaacattctctggagaatatgatatgattctggatacaagatatcataaattactgcacattcttggagggcaactgggattcaatcactcaacatatatttcttcaaaaaccatttattgcactctaagcgcttgcccattttttaggtgctggggatgcaatagtgttgtgttaagtaaggtaaataaagtctctgctttgagggagcttgcattctggcaagcaaactaagaaagaggaatataggcaagtatgaagaatctctaaagaccttcaagagtagacctatcagaagaagagaaaccttggggaagggaagctatttgatgattgcaaatagtagaagatctgaactttagaagaggaaggaacttacgtttctattggatgttgctctgtaagacagaactaggaccaatggggaaggttagggaggcagactttgctcagtatagaagaggacttagtaacaattagagttctactacatctgaaagttacaagctcttgagaaagtgttccagataaggctgggtcgccatctgtcagaggcagttgcaggaggctgcctgcttttggagaagagtttgaagatggtctgtgtggaaccattcaaatctatatccttatgattctgctcaggtaattaacttcgaatgtatcacgctgagctcatgacattttgaaaaacaaaatattttgaaactaagacacacatctaagcacacaaagtaatcacaggtattttggacagcaggctaacgcaaagacatcacatggggactattataaaatctggggcctacagggttccagggggcttacaagaacggatgagaagtagaattagagcccgtggggaatggagcaggagagaggaaatggtgtcaaagggttgacaggtcagggccagggacatgggttctgtcattaaacggttgaagcaggtcactttaattccctagtcctcagttttcttatgcgtaagagaacattttgcatcgatggcttcaactagatctgattttctgagatgagaagagaagtatacatcccttttccttgccacaaaagtcttttgactggcaaagccgatagtgagttcagtagggaagtgtcctatactattgctttcacacaagtttactcacatattcatttactctcatccacagctcggtgttcagaactttgggcagtattgataaacttcacctttcatgtatatttgctaataaggtattgcagttagttatttgattctaaagtctactcacttagatgttaccttacaataatggttaagattaagatatggtcaacaagaacaggaaaagatgttcagcatcacgagtcatcagagaaatgcaaatcaaaaccacaagatgccacttcaaactcattaggatggctagaaacaaaaagttagataacaataagcattggcaaagacagggagaaatcagaacctttattcttgctggtaggaatgtgaatggtgcaactcttttggaaaatagcaaggcaattcctcatgtgattaaacaattaccatatgatcagcaattccgctccaaagtatacactttggggggccgagatgggcagatcatttgagatcaggagtttgagacccacctggccaacatggtgaaaccctgtctctactaaaaacacagaaaaattagccaggcatggtggtgtgcacctgtaattccagctactcaggaaggtgaggtaggaggatcgcttaaacccaggaggcaaaggttgcagtgagctgagatagaccactgcactccagcctgggtaacagagcaagactccatctcaaaaaaaacaaaaaaaaaaaaaaaagaaagaaagaaaagaaaatatatgtttctgcaaaaacttgtacatgaatgcctatagcagcatttttcataatagacaaaagaggaaaacaatccaaatgtccatgaactgacaaccagttaaacaacatacaatgtactattatttggccattaaaaggaatgaagtattggtacctgctgcaaaatgggtaaaccttgaaaacattatgctaagtgagagaaactacatgttgtatgattctattcacatgaaaatacagaatagggacatttataagacaaaaagtagataggtgcttgcttagggtttgggggaggggatagcagggtgattgtgaaaagaatactgagtttctttttaaggtgacaaaaatgttctaaaattgtctgtgttgattgttgcacatatctgcaaatatgcaaaaagccattaattatacactttaaatggatgaatttatggttatttgaattatatatcaataaagctctttttaaaaagtaatatttgaatccgtggtttgaaaatagtctctaataaaatacttgactccccaaaccaggttgtaggacaccccaaattatagccttagttcaaataaggagagtccatttcagattccatttgagcctttaaaatctgtattttagtaagtgaggaactcagaccttcagtctctgatgatttggggaaactaggtttgcggaaaaataattcctatccttttaatgctttctgtgtcatttgtcctaggttctccctcctaaagatgcaattataagatgcagaagagtgaaatatctagaagataccccaaaatcagttgctactatacaccctccagtaagcttctatcaaaaaggaaaattttttaaagaaaaatgttataaaagaggtatattatttttaatactatattcttgcaatttaaaataaggaaaaaatataaagagcttcaaaatgttactgtctcttgttacatgacatggccaaagttttacttattggcatttattaagtactcttgtgccctagatgcttttacatacctttagtcataatcctgtttagggttacagaagcggagtttatagagactgcaatttgcctcaaattacactgtttttggtaagtggtagaaccaggacttgaatctgtatctttcagtcatcagagtcttttggtccaaactgcccttgaagaaaatggaccaacaccatggcttgagttctcctattgctaaggacaataaaataatacaagatataaataggaaagctggctactcaaaagatccatccacaaagttttctaacgtaaaaccacctcctgaagtgagttatccttactaatttctaaaagggtagcatcattgccaaaagtcttcccaatccaaactttcttacttttatgctagctgaattcagatggcagcaccttccctctcttgtcattttctcttgctttcaccctacacaaattgctagtggttgaattgccaacacactagagctcccctagtgcttctcacacatctccagaaatgatgtcagaccagctcggctcatgttcatattctccttggctgatgaaatatttaagccatgctgatagcctcagatggcattttagatgcagaatacaccagcctgttgttcctctttgcagaggaacagtaggctacggcgccctgcctccatttctctcccatgtttatgctaagaatgatacttcttcctaatggtgttttaatcaaaaacagctcatcaccaatacttttttttttctttttttacaaaaagaagccatttctagtaggcttggctgacagagtgtatacaattagtaagaccttttagagaaagaatttacagaaaatgctccattcgttgactttcaattaaaatgataacagcaacagatcgagtgaaaggaaacctgttgccattctgtcagccctgtggcaggtgtgtggtgggagagtgaggctgtctttgcaagcacaagtgagcaggtcattctgactgcagcgtttacacccaagctaattgataaagacattctcattttgacccgatcccatggaaaacaggcaaacaaaccaaaaacacttgtcaaacagctatgttaacacaggtaaggttaataggtgtgagagactagactttccttaatattaatcaaaaataatttaggctttaacacaatgcccttgctctttaattttgatggtaaaaatcagaacacttcccttcaatgccattaatggggtcagcctccaagtctgagcgagtagccatgccgtcagtcccatggaatcctaaaaaccatcatcatttgtttctaaacagatcatgagctatttaccatcccagtgttttgtgcacagctgggtgtctggcaagtgtccaatatccattaacatttaaaaattaggcccataatgcatcttttctggggcttgagaagtatacacagtgacacatggtgggaaccaattacacttgcactaccattagtctggctgcattcaacttcccagtaaatgcaggctaatttagtttccagaatggtgtgtctaaattcatacaataatcttagagaaggctgcatatctaaagatttatagtggaacaaactgctcagcaagaatattacttcccacagtgaaacatgagagcacatcacaggacgattcactgaatttctgcaagtttcctttcaatatgtcctttctaaaacttccagtcaggggatgagttggaggacacaaacagactaacagatttcagtaaccatttctgttgccttggtctgcagagctaccatcactttgtatgctaacagatacctttaaatgtgtctttctcacctttggagttatagctgggttaccttaatccatttttccagtggatggacaaattctgcctttggaatagagtactttgaactctttttgggcattgtattaccttattgcccaagatgagcaaagcaaactctacaattggtggtttggtaaaaggttgaatacagagaagttcagaaataaatgctgtctggaaagtgctgttctccaaacttccactgtctggaacaatttctctaataatatccaaggcaaaatagggagtcaggtctatctggaaagcaacccaaagagaacctccttccttgctaggtgtccattccactctcaaaatcaggatggaaactgattagcttctctggctaatcattctggggcacatactgtaccaagcttcttagctcactcagtctatgtcatgctgcttaataaagctaaattgctcacacaaacagaatactgtgccatgggcttttaggattcagaggtggtttaaaaatataatttttcactaacattcagcagaacaatttagcaatagcttacagaaaattgcaggaaagcagtaattttccaaatgtgcacaaactgattcagcaatttacaaattagagactttgggggtggttaggatgtgcagtgagctagcaaagttgtcctctctgagggcagacttcccgtgcctcaggctatgctggggaacaccatttcctttttctctagcaccttgaaatatttaatggcaaaactttgtttggaggttataactgttaagttaaaaattacgttgactgaattgatttaaattggaattgactccaggaaatgccaaggcctctgtaattgaagagtgatttttaatgagtttggagcaaatactagttctctttcagtgttctcttattttgagaagaccgtatactacaatgtttttcattgagaagcttataaacagcatcgaaggtacaactgcctcatcagggctgttgatttgtgcacttactgaattaggagtttgtggatagcattcttttcttattgtttaggaagtatgaatcactgccacagctgaaaatgtataggataggcagttaggcacagtatattaaaataatatgaatgtgccaattgaggaaaacaatgaaacctattatttaataaaactgtctatatcgtatgtttccagatcattttgtagggcgattttagtgtaaggattaacccaattggtgcagattagatgaggagaggcctgatttgagtgagaatattttctttcaataactttaaaaggtatagattttatctataatagtcatttggatatgtgtcttgcttaaaatagctagttcaatacagactggggaaacaggtgcacttatcttttgtataaaatgcatgcagggttatgatctcatcacacatacaaagaaccctttacaactggaatcatgaacaagaaatgtatttccttcaacttaattatttagtttcctactaagaagttgctctgcagaggtcaattatccttcagggatatcctggaagaaatgaacaattagcttgattttctgttgaatttggagcttgaaactcagtatgtgatctattaaaaaaaggagataattcctcttaaaccatgtcctaatctacattggagtcttacactgcaggtaagaaatcagcaaagtaatccaatccaccaccatggggccaagactgagtatcttgatatacaacaatcatggcttcaaaacgttaatggaaaaatctctcatggggagctatgaagaataacagaattcactcctcttatgaagtgcaaagccttatgaaagggaaatgccatttgattttttttaactaaacagaattgctcaaatctgattaaagagagtagcagcaaacattgtaatttggggtaatcaggagagtgtacagttttatggagagatgaaaggcatgagtatggctttcataagcttcagactatccaggaggctgaccgttacctggctctgctctaaaaaaagctttcttgccctaagaaacagaatttaaagtggggactaaattgagttaaaaagcatcctgcacagagcttttcagaaaagcgctgaactcgcctatgtaatgaatctagagaaaaaattattttctctctggaaatgtctttctctttttgagttatttaaacatgggagttgtaatacaacattcttttttatttcagtttttaaatttgaggatgctggtttcagctggctctatttccttggaagtcagggctatgctttaagcttaataatattggatgaccctcaagacctttaaatcaccttcatgtcactgatttagcatttcccctgaggatgcattcatttgttctgtctcagtcctgaaagtctggctttaacacacacataaacgcacatgcacacacacacacggaaaagagatgaaaatatgcagagggttaaaagaagaactcaaaagtatattacggagtaggaacttgctagagttgtgtcatttaaaagataatcccaagcaaatagttttatagccagttgctggctttctttacagcagaaagatctgttttatcaaaaaccactgagtgggtggcagaaataagtctctgcctggagatgaagtagagctctcttaaatggctgctacttatgataccaatgataacttgtaataatgcataacaaagagcaccctgaattcatttaaccaatttcaataagattgaaacacttttcacacattttcatttactttttttttttttttttgagacagagtttcactcttgtcacccaggctggagtgcaatggcgcggcctcggctcactgcaacctctgcctcccgggttcaagtgattctcctacctcagcctcctgagttgctgggattacaggcatgtgccaccacacccagctaattttgtatttttagtagagacggggtttcaccacattggcaagactggtcttgaactcctgacctcaggtgatccacccgcctcagcctcccaaattgctaggattacaggcctgagcctccatgcccggcctcatttacttttacagcatgctggaaaagcagagtgggcagatcttacttctccctctgcagtgaagagatgtgaagaccagagctgagaatatgtgaagtgagacaagattaggtgcttctggttgaacccctttgagttatttttttctaatatatatccctttcaacatttttctgtgttcaatttcacactgtttcccatctggcctaagtggatgggaggggagtcccaggaattcaactcaatctgaaagacatgctctttgattttaatcttcccttttccttaaactcaacttctgcagactaccttgacatgacctagtaatcccaagccatcagactggtgtccaatgtgaccacaagagattttatgaggaaatgtatggtctgaccactcagaatggacgtgtttttccaaaactaagcaccaacctacttggcagcttaatgtgtcctaaaggattgggtaaagggaactatcacagcttttggtgtcagacatacctgggtttaagcaatggctgatgcttggtctgagtcctcacttcaccatctgcaaaatggagataagatcagtaatcacctcagagagttatttattttagtaaagaggaatgagataatgcaagtaaaacgtgtctgtaattatagtaggctctcatcacagacccagcctgaaccaagcaacttacatcttcatgatccatattagccttggactcagtgttttctccagccttgtctttcctgtgtacactttcttagtcaaagttcccaagtcctaactttttgttattccatgttgaatctcacaaaggaatttcccaagtatactctttattttgaaaatatattacctaactcgtaaagtcagaaatttttcttcggctatatagcttccgaggtttttctgcccaattgccctccagaatgtgtaggttgaattagatcaagcttactgaggaagccaattactaatttccttcctatggagaagtgaatttgccacgagaaggtctcacatctcataaaactgcctgtgacggtgtaaaacgcatcatgggagtttccaaatgcatttctctgctttgctacgagtattgaagcatcagagaatattaacagtgacttggagccccaaagtcactgctcagcccattttccagatgaagacactgaaacataaaaaggtcgagtagttcttcagttaccaaaatggagaagagccttgaactactgacctctagtgttgtaccttttgtatctcagaataaagcacactctttaataaattatttgtgaatacaagtttgaaggcaatgtctattcataaaacaactgacctagttaatctaggcaatcaagttaattaaacaattaattccttggcaggtgaaaggagggcaagttgctaacaagcaaaggactgctaaattggctgtttggccaattgtttgatgaaatcatcctcaagtcagtccaacagtcatttcaacagccttctagatacaagacagatcaggaggtgatctgtctccactgctgtgctgaatgaatgggcagtggtggtgatagtggtgggccatccaatttaatagaatgagatgattttcattctttgggatttacaggatgcataattgtggctagtcattaattttttcttattcaaatggaggttagttcttgatgagccgtcacacatttctttcccttgcacagtgatttatttcctccattcatttttccttcagtgacactttctttttcctaatttttttttaactttaagttccaggatacatgtgcagaacgtgcaggtttgttacacaggtatacgtgtgccatggcagtttgctgcacctattgacctgtcctctaagttccctcccttcacccccaccccccaaaatgccttgtttcccgccctgtgtccacgtgttctcattgttcaactcccacttatgagtgagaacattcagtatttggttttctgtcctgtgttagtttgctgaggatgatggcttccagtttcatccatgtccctccataggacatgatctcattcctttttatggctgtgtagaagtctatggtgtatatgtaccacattttctttatccagtctatgattgatgggcatttgtgttggttccatgactttgctattgtaaattgtgctgcaataaacatacgtatgcacgtgtctttatagtagaatgatttaaattcctttgggtatatactcggtaatgggattgctgggtcaaatggtatttctggttctagatccttgaggaatcaccatactgtcttccacaatggatgaactaatttaaattcccaccaacagtgtaaaagctttcctatttctccacaccagtacccattgtttcttcactttttaataattgccattctgactgaagtgagatggtatctcattttggtttgcatttctctaatgatcggttaaagtgatgcattttcacaaggcctaactatattagttcattttcatgctgctgacagagacatacctaagactgggcaatttacaaaagaaagaggtttaatggacttacatttccacttagctggggggtgcttcacaatcatggtggaaggcgaggagaagcaagtcacatcttacatggatggcagcagagcaaagagagagcttgtgcaggaaaacccccatttttaaaaccatcagatctcatgagactcattcactatcatgagaacagcacaggaaagacccaccacataattcaatcacctcccaccagattcatcccatgacatatgggaattgtgggagttacaattcaagatgagatttgggtgaggacacagccaaaccatattactaacaaaagatggacaaccaactcaagtgcaaagttaaatacaactgttcaaaggcccttctccagaaattaagcagatatttacatgacagccagaatgacaggagaaatcagtcaaaggtgattttaattttttctctttctctttgcttctagaatcatacatttttcctaatgaactgagagagatgaagctgcctctctgatagtaagtttcacaacactcagaagcacaagatggctttgactcccatttctgatttcatcctgtcattctttttcttttacagacatgtttttttctcatcggtctctgagagttaggaaatgtttcaaaggctatagcatccattccatatatcttagttgtccccaaatgggctctgcagaattatcttcactaatgtagggccagcagtgagctctgtgacaactacttatgcaccacatttctgggtgcctaactactcatatcacatgaaagccctaggtcttccacatgatggcacataaacaagactaatccctgaatgtcaccagctcagaggcacctcttgctaatttgggaattcccagttcccctccccctgccaacttgattctctaattatgtgtgcaggcccaccctgggatacagtcatgtaggatttagtctttcaaattctttgcaaggtgtttccctagacttggctgtgtcctgaggaggaagactgctcagctcagcagtaatcttgtagtttggtagcctttagggggcttgagctgcacaataatgggggtggagtggggctggagacccactagtggagagagaaagaaaaggccttctcctcaaatctctgttgtgctttgcacctgggttccagagtaacttaatttgggccctgtgatggttaatattgagtgtcaacttgattagattgaaggatgcaaagtgttgttcctgggtgtgtctgtaagggtgttgccaaagaagattaacagttgagtcagtggactgggagaagcagacacaccttcaatatgagtgggcaccatctaatcagttgctgggaggctagaataaagcaggcaggagaagatggaagagcagacttgctgagtcttctggccttcatctttctcctgtgctggatgcttcctgccctcaaaaatcagactccgagttacttggcttttggactcttagacttacaccagtgatttgccaagggctcttgggcctttggccacagaaggctgcactgtcggcttccctacctttgaggttttgggacccagactgatccaccattggcttccttgctccgcagcttgcagatggcttattgtggtactttaccttgtgatagtgtgagtcaattctccataataaactccttttcatatatacatctaacctactagttgtgtccctctagagaaccctgactaatacaggcccagaattgcataacatcatctatgaataaagctctttttgtcctaaagtctccctctctttgtatttcagactgatgtccaccagactggtggtgagaggagaatgagtgggtgacccgaaggctaccatgccaccacttctgctttctctttttctatctcaacacccttcaaatatacaataaccacagccacactgccgtcccccaaatgcttctttgagtaaaaattcaagcctccttgaacattaactcgtggaaatgtatatacgtgtgttggggtaggatggagaagcagatggatggaaaccttcttaccttgaagtgcatgagctgagtggggaagaaaatgaaatattggagacagctggctaggctcttcctgtaagggtgtccagttctcttcatccaatgggccaggctgtttcccaggttgtcagagggtaaatcctcttcctcgtcagccagtctacagtgtggctgactgcaatgtctgcttcactgacttccagaacaaacacactgatgaacgttttcagcagctctttactgaagcgttcatgtaattgctctctaaccacagagtcaggagacgagggcagtgaaattgtggcgcttgggcactgcacataggcctttaggatattccaagtggacaccttattgttcactaattcaccccatgctctgtgcccatccttttaaagcccttccccatctgtgttcccagcatcattcttatccccttccattttcctccaataggccttgaaattcaacaccctggccagaataatggagccatagtatccctgacgtgtccagcaaattctgagacgatgggtctcaggcctttcctgcctatcatggctttttccttctctccagtctttcccagaacacagaataaactttcacatagagcctgctggttctgctgaaagcacttccccctcccctcaccacctgccttccttacccttctcagatgctttcctttgtaagacactgtgcctaatctttgtggtgggtttatatttctccttctcagcatacctttttttttttttttttaatttgagacagagtcttgctctgttgctcagactagagggcagtggtgggatcttggctcactacagcctctgcctccagggtttaagcaattctactgcctcagcctaatgtagctgggattacaggtgcacaccaccatgcacagctaatttttgtctttttagtagagatggggttttaccatgttggccaggctggtctcaaactcctgacctcaagtgatcttcctgccttggcctcccaaagtgctgggattacaggtgtgagcccagcctccacttacctttgaccttggtgttttgttttgtttttgagaatgttcctggccttatttgttaaagacacacttgatccctccctgcctggattatattctgaaattctaaatttccttagattaattcacatgaatagcaccaaatgcaaatctcttttttctagcccccgaatttctttctgacacacgactgtgggtggaggagggaggaggactcaagggtcagttttcacccgatagcagtagaggctgtgctacctaaggagggtggggtgggatctgtaccttgagagtgcatgttaagttttaaacatgttctttcgtcttatgaaaaaaattactgaagacactaaacctttgtcttaggttgagtccctcagaagcagcccctgagacaacgatctgagcataactcattcatttggaaggtggtctcaggaaacactaacaggggaatgaagaagtgagtctggaagaggatgaaaggaagccacaaagtgtgcggggctccctctcctcccaaaccctgggagactgaggaaattaccacagaggtgttgcccaaggactgggaatggtggccatttttctcctcctccattattgagtgctgctccaggagggattaactcccccagcatttctggcagcccctgccctctgttagaaaccagacccctggggcagagccctaggtacttgaggttaggcgccaatagcttatattaggacagtcacagccccagcagaggggaatgggcaggacactcacttccccatctgttgtgccctattcaaagacatgaatagaaacacacttttatactttactggtcagtgacccagaaatgcagggaaccctccttccctttggtcagaaactactccatgcggtttgctggtgtgattttcaaaatgaaagtccttcccacaccccctccacagagaagggtccagtgaggagggaggaagtctgctggagttttatatcacctacagtcagtgttctttgttttgataactcctaagaaagtagttagtgtctgattaatgaaaataaatatttattaaatggaagaataaataaagaaactgggactgaagccaaggacacctgatcccaggagttgtgttcttttcatttcattcagtctttaccttgttagggaatccctgagctagggagactggaaacagtggttgccaccagtggtggcaacgaagtgtccctcactgggaatttgcagccttggctgataatgcttttgtgtctctacaactgggacctgtaaattggcctgctaacctcaccagaatgcaaaaaaccccactctattaagggctgttgaaaaatcaaccaaaatgtcaacactcttaataacagatctattaataattcaaatgttttagtaacaatataagcatttcctcacattatatcagaaaatttgacaatgtttgcccatatttataattgtggtggctttacttttcagaaacagtatgattattaagcacaaatgcatttgtttctgcactgaatagcctggcttgacgaaaatattccaaagccaatagctcttatttaaataaataaaatttgtctagaaaacttctgaattcattccaagaaaagggaagctatgtttagcatagagctagtgctgtttatgtgtttttgtttcttataattctttcataactggttatggatggtaactttctattcgggatgcattctattccgctggctgtaataggtaacagagtttccatggtgtaaatttgcatacacattatgtagttcacatgcatgcacatttacacacttactacatttgtttattcaacaactacttatttgctgattaacgcttttgtcattaaatgtacaaacttatttgagggccacaataagataattgctctgttaaaaaggaaaacacagtctttgtcttaagaaagacctaattcaaatcccattagctgcttaacattgagtaagtgacttacacccttcaactgtcagtttctacatctgtcagattgtgatagataatccttactgcatgattgatgaaggttaaattagataatacatgtgagtaaattagtacttaattctatgaatgactttataaggttgatattactatgcatatttttacagagaagtcaatcgagattctcccaaatatgagtcctccaatttgcacagaatggcacctatgtagctaacccactgagggcacattctgattttgccctcagtgtgttatttaatgggttactgagtgagatctgacatctcactttaaagttttcagggttacatagaagtagcaagaagattcctcttatctcagatgacactacaattgttcttatcagggaagagacatagaatctcttttttatcagttagatactcattaaggttagcaaacttttattgattagtgaaggagtgtgtggctggttaaagggatagtagcagcttaactgttaactgcgaagcaggggacgcctaaacacttctctaaaagtatttttatatattttttgctgggtttcattaaacatccagcatcaaggcctaagaaggctgtttaaatatttgaaagaggattgattgtgtgttttgacatagttgtccttttacaggagtatcaatgattgtatggattggttgtcggtttgatgtacttgcatgagtggtgttgacaaagtcagaatattcctgaaagtacatgtttggcttcaccagcagcattttgtaatattgaggtaaatatttttctttgtgtgtgggaacacatttctaaaatgacaaaggaagagagtgagcctacatgatttttgtatacaaatatttatcttatagacaacttttcaggaacatttagtgcataaagccaagtagatctatatatcgatcaggctggctggtttccaggctaggagaacttgattcctctcccataaattcactattctctttatagtcccaggattttcactggcagcatttctcccaaggctacaaggcctttgccacctacttgggcatgggcgaagaagaagaaaaaaaaataaaggaagaaggaggcatgtatagaacatttacaaagcataaaagtgtttacctttgatataatttttataagaaacctagaagaaataatctttgtatttttttctttgatttttgtcctacttttggcaaaagaaagaggataaggcagcgatgaggtgggtttggagcttggcccacctgcactctcctctaccctttacttgccatccacgtggcctggcttgaaggaattctctccagtcttgagtgcaggctcattccctcaaaactgggtacaattatacgccatgtggggttgttgtgaagattaaagaaaagtactcagcaaacagtaagtaattaataattttttggctatttttaatttttaacaagaatatgatcacctctgggatggcagaatatctactacttagaatatagtattagaaatgggcaagttgctaaattttgtttttaaccttactattgactcaccgtatacttggcgttaataatgcagttgtttaagttacatagaaaatttgatgttgtaatttggtgatgataacatggtcctaaagtgttttcagaaagggatttggaggtaatgagggagggaacaggtcacacagagccttgttgaccattctgaggactttagctttgacttttaccacttcaaggttgtaagtaaaggtgtaaaatgacctgaattatttttttaatggactgttctggtcgctgtgttgatagtagcctatgactggaggtgggaagggaaatgtaagggagaaacaggatgacctttcgggcagatagtacagtaagtaatccaggtgagagttgacaatgactaggatcagtatgattgcagtggaacttttgagaagtaatcatattcttgatatatatgttcaaagcagagacaatagcattgcagatggacttactgtagggtgcaagagaaagaaatgagtcaaaagtcacttccaagtttttagcctacgccactggaagaacacagttgccctcagtagggatgaggggaactgaagtagagtagattcggggtggaagatcaggtgttcgtttggtacatactatattttaaaatgtttatttaattcaaggtagagatgtcaagtaggcagtcagaaatgtgaaactgcagtttgaaaacaaggtcaggctggagatataaatgtggaaatagcttgcatacagatggcatttaaagctacagactggatgagatcaccaagaaatatgtgtggtaaggaagacagcaccaagggctgagccctggaagagtttactttcattaaatgatgtctcctgaagattaaaggaaaagcagcattattcaaaagaggccatatctacatttgatcactttcttgccttgtaattgcaaaaggtttaagtcctcctgcttttgccaggattccgctgaaagagaggctgcaatgggactcagaacacaataccccaaagtatggcattttgatatgctgagtactttaaacttaaggacattagaagggccttatgagcaggtcactctgaccttctgttgcctttctgtctcctgccccattttctccccaaaaagggagtcatagaaaccagaattccttttccccaatgtaggtcatagaaattaggattcctctccctcaaaccaaaccataaagtctacagaggttactctttccccaccccttgaagattccagaggcatcctgccccacacctgagaggaaggaatgctatgcaaggaggtcaaggagaatctgaacagacaggcctcgctgggtttccctcctcagtctattagcacaagttcataccttgtgcaatcacatctctacacagctgttcattcttcattgaatctaagcataaaaatcgacagctttcccttcagaaatgaagatctaaaagccctatcttcatttctgaagatctaaaagatcctatgtcacacaaaattttgattaaatacatctgttatgtttttctcttgctaacttgctttttgctacgggagtttcgactatgacccttatgatcagtgaggaaaagtattaaaccttttagcccttacaatagtaaacaccagatacaatttaatctctttaattgaatgtctcttaactgtcttggacttgtatctggaatatataaagaacaataataatttgataatgataaaaccaactctcaaataaaagatggaccaagatttgaactgaaacttttccaaagaagatatgaagatgacaaatgagcacatgaaaagatgcacatcattagtctttatggaaatgcaaataaaatcacaatgagatatcattaactaaatggttaaaaaggaaacatacccctcccctgccaaaaaagccagcaaaaactgatagtaccaaacgccagggtggataaagaacaaccaggacttatatattgttggttaggaatgacaaaaggcacagccattttggaacacaggcagttttttttttttttatataaagttgaacacatactcgccatatgtgtttaactttataaagttaaacagcaatccatatttaaacagcagtccatatttacccaaagtgggggtagaaacatggtcatacaaaaacctgtacacacatgttaatagtagctttattcatatttgccaaaaactggaaactactcgagtgtccttcaactggtggatggttaaactgtgatacatccttacgatggaagaccatttaacaagaaatagaacaaattacggacacacacaccaaagtagatgaactcaaatgcattatggtaagtgaaaaaaatcagacttaaacagctacatattgtataattccataaggataatctataaagacagagaagtggctgttgaggactgaggttgtggagaggggttgagtacgaagggcacaagtgaatatttgcaggaaaggaaaccattctacaccttgattgtagtagttatattattgcatacctttgtcaaaactcatggaatgatacaccaaaaagggtgaattttactatatgtaaattatatcttggccgggcgtggtggtggctcacacttgtaatcccagcactttgggaggccaaggcgggcacatcacctgagttcaggagtttgagaccagcctggccaatatggtaaaaccttgtctctactaaaaatacaaaaaaaaaattagcccagcgttgtggcctgcgcctgtagtcccagctgcttgggaggctgaggcaggagaatctcttgaacccaggaggcagaggttgcagtgagccgagatcaagccactgcactccagcctgggagacagagccagaatccatctcaaaaaaattaaaaaataaaaaaaaatatatcttcatagagctgattttttttaaaaaaatagcattttttaaataaaacaataaacagctacaaaaatataataaaataccagaacaaacaaaaaaccacatggcttttagtgctgaactttttgagttaactacgtcaaaaagtcaagagaaagtgagttaccatgctgaagtctttcccaaaggatgggcaagaggtggagagttattgtcctctttcatttgcagcatccaggaacactttgaacaaagccagtgacacacttgctgtggacctgttggatagcacattcgcctcagtgaaagatgaccccacctaatgtactataaagtgtcagcatacaacaagcttgttgtatttttagatcccagactcagagactccatgtatggtattttcacacggggtgaggttgacccaaaacaccacaggcagattctctggagtaaaagatttttaactacatgtcagcaatgattagttacaaagggaaagagaacttgccccacttgacactaaatgacagaacaatttgacaaaagctaaaaacaggaaaaaaatcagtccttaagacaagaggctgatccccagtagtgttagggacaagtcttttgattacatcttttgtcccacgaataataaatccctaccctcaaaagtctttctaggctggtctcctagattttggcctggtgacctccaaagtataatttgcagagttaaaggaatctgacctgcatttaatatttagttcctatgtatctccacaaagtatattctggagagggagccatagaatttcattatccctctacataccaggtacagcacagacaacatgttctatagttttttaaagacctgggtagccagttaaaaccctgattactgaagatgctctttaaaacctcttgacttaggcctctagcctggttattgttaataattgtgatgctggctttctgtgaaagctcaatcacaatatttaatcatgggacatgcaaggctttgctagggatagtgtgcagagacaccagacaggcccctgtcatcagggctggcattggggtgggaagaagcaggacttaagtataaaatgataatcgtcataatgatggtaattcaaagtagcatacaccaaatcacaaatgtgtggtaggaagagcaaacacaatggagaagtagcacatcataaacagaggtttgagaatcaaatgtctctgcccttgagtccaggttccattcctttttagctgaaacactggaaactcacataacttctctaagccttcatctctttatctataaaaaacagatacataaatttcactgcctaaacctgtaagaactaaaggggatcatgcctataaatgtttaaggacagtgtctggcatggaaagcactcaggaagtgttaactcttggtggcagaagaagcagtaataggatttgaaataagcagtgacttctgcagtggtacatggtgtgtacttctggggaggtcctaggtggaactataaatttggaagtattaaatagtacttaaaatgatgggctggagggagattattcaaggagagaaagtagatgaaaaggaggataaggtctcgtctggagcccttccgcattccaaagttcagcattttggaattggaactttttcctcctttttccttttcattcattttagaataaacctctacaacattttacgaattccccacaaatatcacagccatggaattagagctctctacctaaatcctgacaggcttctccactcactttcatttctgtcactgttagtggaacgtggaaaaataagttacataaacttccgttggcttatgtcattttagtccaggtctccattgtcaggttaaaggttgaagcaattatctggataattcaggtagaacttaccaggcctctgggacccctttctccttctgctacttttgcctgagtaaccagggaatcacttcaatcctttttctgctcatgtaactctggtctgactacgtctttacccactggaccttgtcactgaaacaaatatatcatattggaaacaaataccagtgagggaaggcatgctcatttcaaatgtgggtgtatttaatttccatatggactatgctgtgagccagtgcaaaaggcagctctaaagcataagggataaatgaaggcagacagtcaggaactgagtccttgtcagaataaaaggaaatcaatctcacaaaaggtaaaggagatgaattttcttgacaagagcctgtatcaccatttattgttatttatggctttttgggagaatagctagaatactaaaataaggaacattttggcccatgtcacaaaacaccatgtgaatttacagcctcctcgttagagatatttttctgatcaagaggcagcacatcaccctcatgaaaaaggaagtggcggggagggggacagaaaagagatttttgatggaaaagcctggaaagttttacttgtttaattgcttgggttgggataaataacagcagagtaaatgaaaatcgcactagcaaaggataccctcctgtttgtgtgactgaatatataagtccatgaaacttatggtggtgcccaaatagagagaagccactagctctaactcaccattgaccgagcctgtcagatcttatcttaatgagctacagatcccaggacaggagaggaacaaaacgaagccgtgtgataaggtacatagtgccgtaattggaccaagctgaggcagcggtgttcctcaacagcagctgtgggtacaaatgaaagggctgtcagtcgcaaataatttgctatgtttcagttttcacttttgtccatagggtaggatgtcagaagaaaagtctaagagcatagctttcccttctgcatttgcctgccagcatatttctctctatccacacttcagcaaatttaacaacatgacaaatctcgagatgtttgaaatcctttatttacatgaatccaatatactttctcagatcttacaaccttactctgcatccagtaaattccctatgttgctagtgcactgttgcaatttgcattgcattttccatgatttgccagtgttcccaagaaacactcagtaaatactgatgctgggcactgtgaaatgagcccttcagagtaaactgaggttttgttacaaatgaacaagcatttagcctcccgtgatccacagcaattttatgacaattccatgggcattgttttagtaatctaatgttgtataacaaactacccccaaattcagtggcttacaacaacaatcgattatttcttgccattctgtaacatggattgggcttagtgatacagttcttcagcactttgtggtgtctgctggggctggaacctgtaagatggcttcttcactcacacgtctgccgcttcagctgtgatgttgggaacagctggtggctgggcaggcattcctgtccacatgccctcttcatgtggagagcatggtctcagagagttctgatgtgttacatgatggtggcttgcaggaaggaggaagcagaagcttccagtactcttaaggctagggcttgtccaagtacatcacttctgacatattgtagtgattaaagcaagtgatggggccagccccaattcaagggaggggagataggtagcggtagggatagatccccaccgttaaggggatgaatgagcagtgtgtgtgtgtacagggaaggaaagaactgatggtggccatttttagaggcctcatagatgtgtcctggactgcttggtggggactgaggagtactggaattggatttgttgcttgtaactggtttgtttcttgttttgagcacatgatctcagaggaatgaggaactctagacatttaaacagggattctcaaacaattttgtggtgatccatactggaagttttaggaaacaatgttgactcttaatctgtgcactgaattctgaagtcctttattctgtttcattttaaagaaagtttgtcttgactcttgacattgatttcattatctaccaatggcataacattgtgatttgaaaaattccagtctaatcctatctactcattttagagatgaggtggctaaggattaatgaggttgagtgactttttagaggcaggactagtatgcaggtcttctgactcagaggtgattaaatgccctatcagttcaccgtactgcatttataaatacagagtaagcagtggatctaacgtgagttattaattttgtttaatctatacttactcattatggtcttcacaaaagtacaaatgagggattgttgtttttttaaatgtatttttttctcattcccctacaacttcaccatgcttaatataatttttcaagcatgagcattaactcacagcatttctgagcaagtatataatgtataacctattctctgccctcagactgttttttttttctttttgaggtggggggtatagtttgcctacttcacaaccccaggggatataaaagaaataaaaatccataaatatcgtcctatttaatattattgtcaagaggaaaaatgttctgactttcctattatgaaaaattggagtagtattctaatgaagatggtggaaaggtccacaggagattttgaggagcaggactgtcttccaggaaaagttttagtgtagttctgcctggagtcatagatggactggaggacctacaaatccaaaagttactcactttggtttagtggtgttatggggcttcattaactgatggttccattagatttccaacaataaaactgctttttaggtaaactaaactatctctaaacttggagctgcaattgatagcgaagagttggatggatgttactttggttcttactgcagtttgatggtctagtatagcactattcaatagaaatataatgtgagccacacacatagcatttctaaacattctagaagcctcgttttaaaaagtagaaagaaataagtggaagtaatttttttaagtttatattttgaaataagtttagacattaaaaagttgcaaaaatagtatggtgttccagtatatctttcacccatcttcttttaatgtcagcattttgcataatcatggcaaagttaacaacactaagaaatcatcatagatccaatattcttaactaaattgcagactttatttggactagtgaaataattaactcaatagatccaaaatattatcatttcaacatgtgatcaacacaaaaaattattaagatactttacgttccttgtcttgtaccaaacatttaaaatctggtgtgtgttttactctcacagcacatctcagtttagccagccacgtttcaagccctcagtcaccacatgtggttggtggctactgtataggacagtacagtcctactgtcacaactcagagaagagccatcatgaacaatctacttattctgcatgtgaattatctgtagggaacttgaacatatgcaacgcttatgggagaggcaacatggcttgctgttaggagcactaacctgggagccaggcagagtggaattccagctctgcaacttatcactggttgtgtgaccttgacacgtaactcaaactttctgggcctccttttcttcatctgtcaaaaaaaaaaaaaaaggaaatagaaaataaagaagatagcaacaactcatggggtaatcagatggactgaatgagataacacgttaaatgtgaacacagcaacttacctggagtcggtacacatcaaatgttagcttctagtcgtcctctatgtcactgccaatagatcaaatatatgtgcactttctttgggttaagtgatatgaaaagaccaattagggctctggttaatactttagaaaggctcaacagatgtttattgagtacctactatttgccagacactgggctgagtgctagaagtataaagatgcataaaaagcacttaaggagtttactatttagtaaaagacaaatagcatttaaataagaattctgcattttctgtgtatatgtgcttgtgtttgtgtatctgtgatggggtggaggatggaaattgttgtggcaatttaattaatttttaaaattataaaacaaacatacctttaagagttatgaaaacagtttaaaaaattgaatattggccaggcgcggggggtcacgcctgtaatcccagcactttgggaagccaaggtgggcggatcacaaggtcaagagattgagatcatcctggccaaggtggtgaaaccccatctttactaaaaatacaaaaattagctgggcgtggtagcacatgcctgtagtcccagctacttgggaggctgaggcagaagaatcgcttgaaccctggaggcagaggttgcagtgaggcgagatcacaccactgcactccagcctggtgacagagcgagactctgtctcagtaaataaataaacaaataatatcagtaatcctgtcatcttcacaattagctttttctgtcttttaaaatatttattttagagttttttcatttgattaacattgtgtgattgtaatcatagtgtaggtacagtcacttaacttctatattgctagatatttgctgcagaatctgaaagactatttgtaaagagacagttacctaaggcatttttaaataaatgatttaagctgcattcattagtaggaataaaatttatttatttcttattacagaaggaggtggtgaactcatggaggtggttagatgtgtttaagaaagctatcagtggtaatgataatgatagagctaatttttcctgagcacaagtattgtgcaaacccagcagtatgactgcagagccctgtcttgtctaataacctgtactgtcttcaaaaaaatttgtgtgtttgttttaatctgagtgtaatatatattgagttcttaaagtctggatatatacagagatgtagaaattcacaataatgactctaccaaatgtgtaattgtctttgggaagttacactatggactatgtcctttcctccctccttccctccctccctccctctctccctccctccttccctccctccttccttccctccctcccttccttccttcctgctttcctgcctttcttccttccctccctcccttccttcctgccttcctgccttcctgcctttcttccttccctccctccctccctccttccttccttccttccttccttccttccttccttccttccttccttccttctctccctccctccctccctctggcctctgtagctcctcaccaggccaattccaagcctccctccctcccaccctcccttccttgcttccttccttccttccttccttccttccttccttccttccttccctccctccttatatagtctgcatttactttgtattatgtgatcaataattttaactaaattgtctttttatgttatagacgcaatttgagggatgaactatcttgcactttcaaaacgaaaactaaaatctcattgatgtatttttaaatattctattcattgtgtactggtcacaagacaaacagatctaggtttgaattctggctcttatgtttgctaaatatattctttttgggcagcttaccttctttgagactcagtttccttatttgtgaaataagaacaagaaaagtgcctttcttccggggtagttttgaggtttaaaaaagataatgtatgtaaagcttgcactattacaaaatatacttcacacacattgaccacagaaagtgttcaataaatggttgtataacagtcagttcaagataccacagttaactaaatgtgatctttgtatcacagcagtcattttgaaatccgggctttttttttccaagataaaactgctttgttttgcctccattctcttacttctcatttatcttttcaagaatcaaatatagaggacttaaagcaggatgtttcttttattacttaaacaggattgctcttctaactctatcagtgaggccatgaggcttgctgccctggcatggaaggagaccatgaggaaaaggaaatggaaagccagaagttggccccttccattccaggaggatgtggggaagaagcagacagagcaagagtaatgagatctttctgccccttggtttggtcggcatctcattggcacaagggaactttagaatcatccacataattttgggattctgagaatgtgagtgctagtgctgtggtacatggggggtggcgggctgcaggctcttataacaattccaatccttgctatagcccaaattggtttaggagtgatagtgctgtggctctgagggataagcttgagtgagcacccctggctctccttggcctgtggaaagcttggaggaattggcctggtgaggagctacagaggccagaggatcccaagatgggaatcaaggaaatgaatttaaatggttgggattatggactttagcaataaacaccagaatctcactttcagaaaaatgtgacatagaaacattatacctctacagcacaagctgaccacaccatttgtagcagagaacattgggtgaattcacagattctgcctccccagtgccagcattaggtcacattatctacattcttctacatgacaacattttgacaagtagcagggaaaggataagattgttcaaaatcctgaaaagacactgtttgatcagaagagactgagctatctaaagagaaaaagtcaactattggatctaagtttttcagattgggttaaaatttattttttcccctatcaactggaggtgtgagtgtatatgtttgcatgagttaaaaaggatgggaagttccttttaatgagatgggtaagattcttagagcccttttggtgacagggagatcaaagtttccattttgaacgtactaaatttgagatgcctgttagatatctaaatggagagaatgagtaggattttaggtatgtgagcctgatattcagaaaagaaggctgtggcgaagataaagatggagttacagcaaatagatggtgcttttgtgccaggtcatagctggcccttggcaacttaagtgtttgaagaacatatacttctcatctgtttcttttggaaaccactgcatgaatagctggggctgggaggatggaagcttaacttattctcccttcttcttcatcataatcctaaggaaaatggaaaagtggccatagactacactggcctggagggtgtgtaatgctgctgagcatgaaattcttagacatatgcagggttgcccgtatggaagggactaaggcaagcctgcccacactcccacgtacttcatgaaaggagtagtgaggacactatttgcacatcatccaggttgatatttttaaaggaaagtcccattcttttgtagcttcatggtttaatatgaacgcatgagaagggatgacattaaaggtcttttgcctctggttgaacactaacaaaagccacttaccttctactgtttttcccaatagcttatttatgatctaggcctgaatatccttccacctgtctattggggttttcaccatccttgtgtcatgttcacgctttatgatgtggcgacatttaaggcatgtaactctgatttccttccttccatttgtactatccatgtttacctctacttcacatatccatcttctctaagtgtgtgagtacgtgctctatttcatgtcactggagagggatgctatctttccaagtagatgcatttgaaccaatcttctcaccatcactgacataatatacaactccagctctgttgaggtgtcagcaggtccgttgtcatacttgacttgttttgagttgctgattctgtggaatctatcttcttcttgaaacaaatgaagtctccttttctgagtatctcaaacaaagtataagacaaaggctaataattaccatagtattaataacattaattataatattgatagctaacacttgttaaatattttcttacatactgggttactgggttcattttttcacatgtgctatcttagacacaggtgaggtaggatatgggaggccatgtacctagtggttaggacccaggatctgaagccaaactctgtgggttgggattttgacactgtcacttgtaagtgtgtcatctggaccccccccttttgccttgattttttaatataaaaaattggaataataatagtgaggaaaataagaatacctattgcacagagttgtttcatggactacatttggtaacacatccaaaaaaactcagaaaaacacttggcaaatagagatccatcaatatcagctttataagtatcagaatgacatgttctcctgtcaaaaatgagaaaaataaattaaatataagcgatcctaaactgtaccatgataggtggaatattcagacttaaagccaggtttgtttaaggtgatacatcatccagtaatctaggggccaagaggcccccctaagatacttctgatacttgtatataactaatgaacgtgcattctaatgtgaactggtggcaaacatgccacatgctgtatcacatgagtacctgttatatcacctacaagagaagaaaacagtacttccattttgctggactttcttaccagttcagataactctgatccatacgcaaactaaaaaaaacaaaaataaaaacagcagttgtgtggatatacctgactactaccacatcagttcttggcctatatatgtaaaagtattttctaaactttaaagctcttatgattattatcctgggatgcctattgcgtgggtaccaatacctaggaatatttgtgccatctggatagaaataaaaaggccctgaaggttgatgttataactctcaacgcatttttttccctctacttttcttgtttctaatgttgacaaccacccacatggtattcactggttctcagtgcagcccacagaaatgccagctggctgcatgccagtgtcagggggatgagattgttgagagcttcctcatagcaaaaccctgtcaatgacaagcattgtttctgaatctgaaatatttttctttttctgtccctttggtttctcttcccactggggaatgggactcagaatgggtaactaattatatcatggtagctgtgatgtctaacaacaccagttctcatatttatgcagcatcactcacttggctgtaccagctaatatgtgaagattgggtgaggctgtcagcatccacgtgcagcgttgccggcaagtctggtgtgcctctttgtagctccatgcttactttcaaaaatatgatttgttttctccaggcctgtccaatgcaccacatttggagagaaacacgataaaaacacaaaatctgccttctgcgtattttttggcaattaaacaatctttttcttaaatgaatagaaataccaaattttcctgtttgagaacaaatgatcaccaaaattcaatcgcaagcatttgtaaaccaaagatccttcttctatcctgataacaacttctcaagtagcatcacagattcactctaaggaatattctttatttggaatccggtcttgtgcacattggattgctgattagagcaataaatgaaggaagcttggagagctcacagcacttcctagactgtataaaaacacattaccttttactcaacaagcatagtgctttaaaaattgatcctcactgacttaaggactttttttggcttctgaaatctctcatgcaaaatctaagggattcagactgtatgtattatacacataatgaaaattggtgagccttcaacaagtgtatgatttgtgcataccatttcaataacttcatatgttactgtgcttatattagtccgccaggaatgagatcagttcaccaactcaaggtttctttagataatgacggagctaggattcataggcttatcattcaagatactcctgttttacactaggtattgtgatagttcagaatattgtattatctcttgtggtgaacaatctcctaccaaggctcctagagattgccaaattggatttcaagtaactctggatttgagtacaacaataagagaatgattgattgatgaccctcttctaccataaacgtgaggtttccttgtgtctgcaatttctgaccaagtgatgtccactaattatgtacaatgcagctacggtttggaatatttcagttgtccttctaggtctgtgaagattgtgcttttctttggtagaacaatagatgaattagtgtttactgagcactatgactaggcgtgttctaaggactttacatgtatttaatcatcacagctatcctatgaagtgacattactgttttcctaattttcagacaaggacactaaaacacaacaaggttaagtgattttcctagggtcacacagttggtaagtagtgggaggaaaacagacccaggcactcctattccaggcatagtgcttctaacctctgtgcccatagagtttgagagacagcttttttgtagaagtagcagtaagggaatttttcagtattaggtgaatccagtagagaagcaaggactctctgatttctaatgcacaaacttcctggcttgttaggtttctttgcctgattagtaacagcttgcaggattccttaatttggggaaaatcctaagcctactgtagctacacaatttctccttagcaacaaaaatattctgaatgggtaacatactgagagcacatgaaggaattgcaaattgtaaatggtataagcataaagatttcctcaacacatggctgtggtggtgataggataggcatttccaagatgggtaccatccacagttctaagctctccctaagaaagaaatagggttccacccaaaaggaatgtagtgctcccaatggttaaagtatctggtcatgtatctagaataaggagcactactgtgccttcctatcagaggaagtgtgagcatcacattttcaagttacatacaaggttataagacattttctttaaatgcactacatggtgcatttgattaaggactgaactttcaaaggattcctttgagtagagtgttttgatttgctcctatcaggcctagccctgcctcataaataatggaacaagccttgcatgcccctgaattctgagctgtggcaagcatttgaggaaatactgagtcactgagattctcaagagccttaaagaaatgaggaccagttgaaattctacccttggggacctttgcacagactttactttggtctgtggctaggacacaagagggaggtgagccattggttcatttgttttcaacccataccatattattccatataacacaagccatcgcactctggtgtaatatcaactgcattctcttcttggtcttaaccagaccatgagtcctttagtgtcacctcctgttgctccatacaaaatcattagcagcacttgtgcatgatttggttgattctcttgcctgtttggctgcacttagaatcctagagcagttctacaaatgaaaaggtgtccaagtaaaggctctacatgttaggataattcagtaactaacggttgcactgttaatttgattttgctgctgatcagagataggaagagaattgtaactgaaatgcattgcaaccgatttgtaaatgttggtacacattatccatcattgttatgctattatgctattaacataaattatcacatagaggtaatttgaaattgtgaactgacacaggtatatctcatttctggcaataattacacataaaggaaggaggtcaggctaaatgttgcatagtattattgtgtgaactactgatggacagtagtgattaagtgatgttagcattgaaaaattaatttgttcatagcatttctattttttgtcatatataaattttatgtatcacattcaaatgagtaatagttttttttaagaatacacttttagggctaacttctttttccttttctttttcttttttttgttttgagatggagtcttgctctgtcacctaggctggagtgcaatggcgtgtcctcagctcactgcaacctccacctcccgggtttaagccattctcctgcctcagcctcctgagtagctgggattgcaggagtgcgccaccaggcccggctcctttttttgtattttcagtagagacccagtttcaccatgttggccaggctggtctcgaactcctgacctcgtgatccacccaccttggcctcccaaagggctgggattacaggcgtgagccaccacacccagccaggaataacttttctaaagtcacttctgcttcacactgatattgattttactgagtttttgtttcacattttatttttagctttatacatagtgataggacattttctttaaaaagttagaggatacaagaagacactgttaaaaagagaagctctttaacagtgacttcttggttgactacacgaatctccaattcatttgtgtattgatgaagtgccttccctattcttaaagcaagttaggacaaaaacagtaagaatatgcttcaggagacgagtattcattttgactaaaggaactgtgtatgcaggcagattccatgttgactctatactgtggagaaatactttccatttttcagtgtagtctatcagattacatactacatttggtctttgggatggactaatgaaaagaaaactaagatcgattttatgatgggagacaaagtcagacaagaaacattggattcctcagatttaagctttgaaaatcttacatgctccaagcctctcaggcagaggttaagttgtcaatggataccacagtgaaaatagtggacaagtgtcactctgagatcttgccacaaccagatgtcaagaaaaaaatgtaaaatgacaaatggacccttaacagaataatgtgctatcattgcatcctctcccaaagggtcccatcaattctagcacttttgagtctatgcaagtcatacgatacaactatttatgagatggagatgacacaacaacacctgtgacattctggagctctgaaatgggaggcctaaatgggttccttcaggctcaagtctgaaagaagctgcacataaacttatagagacagtgccataacaattcttggttattcttaaatgtggcatgctaaatgcagagtcaggacacaggagttttttttctaagtgataagttctactataatcatgaaggataaaagacatatgccatcaaaattacccttgaaaatctcaagaagatgccatattgaagactgagacaatctctcagtgaatgctacactgccagctttattcccaggtttgataaatcagtagatatttctgtgcaccagatgtagtaggtgcctttcatttagggccataatgtatgagaaatacatatttttaagcattagaatctgagtcaacatagcacagatacttgcatgatgaggggcacgtgagaactggggctgactcgaggagcaaattttcatattctcacactccgtcttcaattctttctgggacatacatgcattgagtgaaatggccaaaactgcggtctgtattgctttcctaaaatttttccctttcactctcttcctctctttgcactgcctcttgttgttctcttcctctcccagacccttccttccttccctcccctcccctatgaactatcagcagttagcattatttgtatttccccaactaactctttgagatggggtagaaacattaagccttaaaaaaccccaaaaacctatatatgttctattctcagctctaaggtttctagtttcaatttctagtttaaaacctatacgtcttattttctgttagcaggggttcttaactttttataggccaggatttttgagtagttgatgaaaacaaagggccattccccagaaaaatatgctgtttgcattcaaattcaaatttttaaaaatcaaggtgaactcatggtcctataatctttaactaagattctctagagtttctctttcaccacaagtttctctttgtaatagcaagtgtcccatgttcttgcaatctaatattctatgttttagagggagactataatgataataatgacgattatactaggaataaataggtaacattcattaagagcttaaatctgtataggcattaggccaagttaactcatttaccctttaccaaaacccagtgatgaatgtgttgttgtccttatttactgttaagaaaactgaggtatagggaagctaaggaatttgctcaagatcacaaaattagtgagcagctgagttatgatttgaacccatttgcttggtaaaaaagagaagagaagatgagcatggccatattgtaccatcagattgtgactctctaacactggtcctttctaatcaggagagcgtccctccttaaaggagaggatgtgccttctcttagtagttgatgtttgctgttgacctaaactacatctatccagtcttacaatcagtcctcctggtaagcacttgagtcatttcagcagttttatagcctgattttggattcttaaaaatattataccggctgaggcaggagaatggcgtgaacgcgggtggcggagcttgcactgagccgagatcacgccactgcactccagcctgggcgacagagcgagactccatctcaaaaaaaaaaaaaaaaaaaattatacctactttccagaacaacttaatttcatattatcatttcagagaatgtttaatttaaaaagatattattgaggcttcaagcatgtaatgacttttcatacatatcagaaatctaacctgcagtaacttaaggaagaaaacaaacttattgaattgtggtgtccaaagaactactgaacagcgaagttgtggaaggagcagggaggccatgaggcctcaggaacaactcacacagggaagcaaataccgataggtcccgctggttctaatctgcttttatttgcgttcattttcttttacttccaactcactttcttcaaatggcaggaaacataaatgaccatagcttataagttttatattttacatcttatcacaagagggtgacagttttgtcattgtcgtgatgtcaatccaaggcaatttattttattgacctaacttgggttaatttcccacccctagaataaatcaaatgtgacttgagatggagaaataggatcatttgtgaaaacatgtcagtctcatagaaatatgtgaatggaatagaaatggagaagttcccaggagaagggaccgggtgatgaatagacaatgctggtttgctgaaaagtaaaactcaactaaatttatttgtttgaagttagcattaagttatagaggtaactattagggggcttgaaaacatatttcttgatttataccattcgatgaatatactgggaaaatggtatgcacattgaatttcattaatttaataaataggtaattatatggaaaaattttatcatgtctttcagcaaaagtaacattattgtgaagtaaataatattatccttaatttggatttttagatgagtacatttaaagcgagataaacttgcaatgaggagccaatgggaataagaagcacctatcttagaagaatagctaggaccttctactgaatgacttctggaagaatccaggactatgattaaggtagctttaagcagagaatgaaagtgtacatgcaaagttcagtgactaaattgtcaaagttttttgatgctgtacctgtcacctggtgctttttaatgaaaggagaaaaatagaattagtatgcacaggacattgtgtaacacaattctaagatgtagacctgggttagccctttgaagaatctgaaatttgcaactgggaaatatcgctggtctagctacagctgccttacattgctatagctatgctgagtaaaagatggttctggataagagtctatttaggaattatgtcattggaaaaggcttgcattttgtggaggtcacattttcagcattgaactagagccaagacgggaagaagaaatttctttctcattcttttttatttgcattaagtaagaaaaatacatttacatttgggacttcacatatttgaaaatatatggaagtcaggttgaagattttcttcttggccagcatcagtgagtgtgagaaatagtggtgtgctgtggatggatacatgcagcaatgagccccatcatttggaaaaatgaacatcaacaatttcagctcaaatacattttttaaaggtgctttatatgtagatttatatttgatattaacaaatctcttttgtttagcatgaactctgggaacatgatgataataatactagggctaatttgtagtaatgttttttgcacctgggaataaatgtgcttttgtacagaaagttcaaaaaacaatttaatgttgaataaatataatctctaatttatggtgatagtaggctgtcctagcagcttgaaaggacaagctggtatatatggggaaaacaaggagccaaagggtgacacagggtgggacaaacgcaagaaaggtgcaaaattgacaagaaatgaagtgtgcttacacagactgtaattgatctaaatatatgccctagccgacagacaccctcctgaagttgccaccttgaaaaaaagtaccttggttagttttatccttgtcccactttccttccaagtcctttgggaagaactttcaggctccctttcctctgttttctagacactaggacaggggcaggaaatctagaagcaatgactcatgtgttatttggaactgatttgaacctagagtctgaccctttgcatcttttggaaatatttcaagaaatacatagccaactccaagaaaaacacatttttaccaaatcgctcagtaataggacagaaaacaactttaggaaaaacttaagtacagttctaatttttattatgtcaagaacatatgagatgaggtggagcctccagactgtctttataatggagataaaaattctccaaaatataccttttcacctcctgcaaataatgacttagggttcagctagaaacttatgtccaaactaaaggttttccacccgttgtggaataatttatttcttttggaaaacttgcaaaccatctctccataagcaaaagagtgaaacaatagtagacagaagggaatagaaaaacaaggaacactttgtcttcaaaataacaaatggttattagagtattggcaaagggataagaagatgcaaaggacagggtgtgtgaagagaaagaagagaaccacagaagggccagactgccagctgtctaccctctacaaacccattagggcagggagagattgggaggggactctcttctccatcctagctgaaagactcccgagaaaaaggcaggtctattagtcttctagggctcccataacaaaatatcatattaggtagcttaaacaccagaaatcattttctcacagttctggaggctagaagtccaaaaccaatgtgttagcagggttggtttgattctgaggcctctctccttggctcacagatggccaccttctcactgagtcctcacgtggtctttcttctgttggccgacatacctggtatctctccgtgtgtccaaatttctcttcttataaggacgcaagtcagattggattagggtctagcccgatggcctcattttaacttaatcctctctttaaggtccccatctccaaatgtggccacactctgaagtactggggattaaagcttcaatttagtgtgggttaggggacacatttctgcccataacagcaagatagctcatcagcctgtcagcctcacaaataggcatcgttacagagatgagcagaaatttttttgttgttgtttaactggagcaatatttctgtaaggcaaggtaacgcaaagtgttgtcatcatttactttcagttatcaagactctggagacataaagtagacagtgagtaaactggctctttgacccaggtgtggcctgacttttgtaacagctcttttcacaggagactgaagtatttagggacaaaatattatctgtttgcctgaggatggatttccaaaaaggctaccaatcctgctacaaaggctttgctaccatatacctctcattgctgtgtttactcaccatggtggagcatttccaatcctgtcaacttgtctttgattttacattttttatcgtaactttctagccaaatatcaatgctgctatcttttatatgttcaaaataaaaaattgcacagtggttatgtttttattttatttaaagattatttctgtttttggcaatctttcgcagctcttttcagctctggtgctacaataaacctattgaaactctgacttttatgaagaacaaaacaagccagagaattatttcaccccacaaagttgggagacagattttatttgcaccctttagtgttcataaatcctatatatctccattatacgtttaccttaagaatggaattttgtgtcttgcttacattttataaattttgtctggagtatttcacataaggaagtactttcatatcttttatttaaaaccaagacatcttctgggctaaagaggtgacttttagaaatggagttaggacatgatagtctgccccaaatgagagacaaatctaaagtatgctgagctaagaagcaagacaggtttcaaaaacctcttaccatatttatttttatatgtacattttatcctgtgttcattcccatatgatctgccatcaattacccaacagtaatgaaaacttctatgtttttacaaggtagagacacaataaaactaactggaggttggcaaggctgccacttcagcttcttttcatattacctgtccctgcatacccctgactcctttcctgtgcccttctttcaagcttatatatatatatatatatatatatatgtatgtattttttttccttttcatctcttaaagctttttccctcatttattttattgggaaaagcatagtgttgtatatcaaagcaccttggactcagactaaccagaaattgaaatcccatctctatacttgctgcatacacttggaaaagttactcaccatttctctgcctttgtctcctcatttctaaattggtgcaaatatgaaaaataaatgagactgtacttataaagcactgagtctagtgctacatagtataggtagtttggctgcatagtgtgaatgaaagctattttaatctttcttattccctctccttattatcctctttaagtctcttccttcctttccttcccttcccctatctcctactcttctttattttctttttggttcattattgtctccagtcttttctttcttcctctaacaatgacagtatacacttacatatagagagatatatatgtaatcagattatcatgtcctaactccatttctaaaagtcacctatttggcccagaagatgtcctgactttaaataaaatatatgaaattatttccttattttatgtgaaatactccagaaaaatttataaaatgcaagcaagacataaaattccatatatatatgtaatttcctgtgacctgatccagtgagtatcaaataagagactatattgggaatccttatggatttttaattatttcaagagcctgagggaagccttaaattgatctgcaatagtacttcattgtttcttttcttttggctccaattaggtcaactcagtatagagaaactggttcatgctgatcagaatctctgatgaggagttataaatgtctttggttttaaaaaagagagaaggtgggggaaatgatcaacttatactttttctgggagtaccatctttcaacatgtaacgttcgtgagtactggagaagaaaatgaacaaattaaaatccttatagttctcttttcttttgtctaaaattaaataggtggactagatccttttaccttttctgaataatagtggtaggaccatgtcagagtgattctttaattgaaacatgctttggtgtttcaggccctcaggcctttcattacggtatgactataagaaaaggttgataaatcctatcattgtattagttatttaggaatattattgaggaccttttttaaccacattattcaatgtggctctggtgtgaaacccatttcactatttcacattggaatccagaaagctcagagtcaaattcaaatcttaatcacaggcattgaagaggtctttttaggctacctgtactctaatatctctggtcctggagtttaaaaaacaattcattgattttcagtttctggtttcatacatacagagcttagagttgccactctatcctaaaaacaagtaaaaaattgaacagattgaaaaatcaactttccttaggtccatcagagagctgaggatgcaaccaaactgctcaacccaagactaaagagacaggcaaatgcagggagtcatggcttgtcagaaaagagactcgggagaggaaacagacatgggaacaacagctagagtaagaaaacttgaactgtaatttgtgaattgctagaggcttagtgtggacaaatttgagtcaaaaactccagggggcctcccacatttttgtcagttttatctccaggagtttaaccaggttttcacagtaaatatcagagaaaatgtccttatgcttctcgaagggaaggggaaaagaagccattttgaaatatgccagagcactccattcttcttaataaggcccacatgggaaactagttaaccagagccccacctgctgggctattatcagagcctaattgacctgggggaaggcacgtactcaactccagtcagctttaacttttcacatgagaaaggaaaatacccaaatttagcccactttagccatcctgtcccacctaagggagatgggaaatgaagaatcactagtgaagtgcctagaccagagtcacaggctcataaaagactgagacctgattataaaactatagaatgcttccccttgcccacaccttatcaccacattactaaagacctatttacaacagtttcttttgcctggttcatcatgcttagctaccaagaaaaaactacaagagaaaggaaataaagtttagcaccacaagaaaatcaccaaaccacaggtgtaaataataacagaggatctaaagacagatcctctaaaaaccagaaaatgattgacaaaattataatctcaataataacctttattgcaaatgaatcaagttcttcaattaaaagttaaacagtggctgaatggattttttaagaagacccaactatatggtgcctccaagggaatcatctcactattaaagacaaacatagactgaaagtgaagagatggaaaaagatattgcatgcaaatggaaatcagaagtgaacaggagtattcatacttagataaaatagactctcagttaaaaactataaaaagagacaagactattatataatgataaaaggctcaactcaacaagaggatataacaattatatatgcacaaatactggagcacccagatacataaagcaaatattattagatctaaaaggaagaatagagtgaaataccataatattaggaaacttcaacaccccactttcaacaacggacagatcatttaatcagaaaatcaacaaagagacatcagacataaacttcaaaacagacaaaatagacttaacagacatttacagaacattctatccaaaagcttcagaatacacagtcttctcaattgtatatggaacattctccaggatagatcaccacagaagtaaacaaaatagagacaaaaaataattcacaaaaatggaaaaaacaatcctaaaattcaagtggaaccacaaaaatactgaatagccaaagcaaacctgagcaaaaagcaaaaagcttgagacatcctacaacctgagttcaaaatatgctatgaagatatagtagctaaaacaacatggtcctggcataaaaacaaacatgtaactcaatggaatagaataaagggcccgtaaataaatgcatgtacctacagccaactgattttcaacaaaggtgccaagaacacaaattgagggaaagacagtccctaaaacaaatggtgctgagaaagttaaatatccacgtgcagaagaatgagactagacctctacctcttgccaaatgcaaacatcaactcaaaatggattgaagacttaaatgtaaaacccccaattattaaactaccagaagaaaacatagggaaacactttatgacttggattgggcagggattttttgaataagatctaaagagcaccggcaacaaacataaaaatagacaaatgggattaaatcaaactgaaacacttttgcacagcaaaggaaaccatacagtgatgatgcagcctacagaatgggagaaaatacttgcaaactacatacctgacaaggggttaatacccagacttccaaagtatttaggagacttaactgtagaaaaataaacaactaaatttaaaaaatggctaaaataccccaatagatatttatcaaaagaagacattcaaatggccaacaggtacatggaaaaatgcttgtcatcactaatcatcaggaaaatgcaaatccaaaccataatgacatactacttcacttcggtgagaatggctataatcaaaatgacaacagaaacaagtgttggtgaggatgtggagacaagggaacacaaacacattgttggtggaattgtaaattagtacagccactatggaaaactgcatggagattcctcaaaaaattaaaaacagaaataccatatgatccagccatcccactactgggtatatattcaaaggaaaagaaattactatgtcaaagaggtatctgcactctcatgtttattgcagcactattaacaatatccaagatatggaatcattacaagtgcccaacaatccaaaaatggatgaatagataaagaaaatatggtgtatatatacacaatggaaatactattcggtcatgatgtgattaaaattctgttatttgcaacaacatggatgaacccagaggataacatgttaattaaaataatccagatgtagaaagacaaatactgcatggtcttactcatttgtggaatgtaaaacaaaacaaaaaaacccaaaacttgatatcatagagagcagaacagtggttgccagagaaatgataaatacatggggttaatagatatgctaatgctcatgctaatacatgagctttctggatctatgggtaggtgtctgacattaatttgttaaaatcctcagttatttttttcaatgaatgtcagacacctacccatagatccaagaagctcaaagaatgccaaaaggataaataccagaaaatccatacctaggcatatatctttcaaactatagaacatcaaagataagggaaaatactgcaaaaagccagaggaaaaaagatattacctttagaggagtaaaaacagaaattacatctgactctcttcaaaatcatccaaggaagaagatagtagagcaaactattttaaataatctcaacagcctagaattctgtgtcctgcaaaattatctttcaaaagtgaagggaaattaagactttctcagacaaacaaaaactgaagaaagtttttacctagtagacctgccttgaaggaaatgttaaaacaagttctttagagagaaggaaaaataaaataggtcagaaataggtctacataaagaaaggaatcatatcaaagaaggaataagtgagagtaaaatgaaaacttttatttttcttattctcaattgatcttacagatgactgttctaaatgataatagcaacaatgtatttgaatatgtgtgtttccatattactcacatatcttgagtgtgtatatattaatataatatacacacatatatatgtgctcacatagaagtgaaataaatgacagcaatgatgcaagggatcagagggaggaattaggattattttattgttataaagtattcgcactaccctacctgtgaattggtatgttatttgaaggtagatttaaattagttgtaaatgtatagtagaaggtttagggcaaccaccataaaaagtaaaataagaagaagagagctgaaggagaagaggaggaggaggaagaggaggacaaggaagatgaagaagaaaaagaggaagaggaactaatatgcaagaaaaatagaaaatggaaaaaatgctcaaatcacaaaaggcagaaaaagagtggaagataaaactaggaacaaagaataagatcaagaaatagaacatagtaatatgatagatattaatcaagctatatcaataataatttagagtggcaatgatctaaatgcagcaattaaaagacaaggattgtcagagtggattctaaaacaagacccagctgtatgttgtctgtaagaaacacactttcaatataaactcgcatactaattaaaagtaaatgtgtgaagaaaaatataccatgcaaacatgaataaaaataaaataagagaagacacattaatttcagacaaagcggctctcaaagcaaaagaagttattggggataaagaagggcattacatgatgaaaaattggtcaactgtctaagaaacgtaataattcttagtgtgtatgcacctaacaacagagtatcaaactagataaagcaaaaatcgatagaagtgcaaggagaaatagatgaatccattatcatagttggataactcaacacccctttatcagaaatggacaaatctagtaagcagaaaataagtaaaaacgaagtttaattcaataacaccatcaatcaactggatataatttgatttccatagactatttatttcaacaattgtagaatacatattcttctcaagctcacatggaaaattcaccaaggtagaacatattctgggccatgaaatccacctgaacaaatttaaaagcataaaaattaatgtctgcttctgatgacaatagaattaaataataatcaatagcaaaagtataactaaaaaattccaaaatatgtggaggttaagcaatatgcttctaaataacacatgagtcaaagaagaaatctcaagagaaaaaatattctgaattaaataaaaataaaatcacaatttatcaaaatttgggattcagtgaaagtgcttagagggaaatgtatagtcttgtgtgcatatattagaaaagaaaaaaagatctaaaatcaataacctaagcttccaccttaagaatctaggaaaaaaggagcatattatgttcaatttaagcagaagaaagaaaggaagaataagaattgaagaagaaatcaatgaaattgaaaatgggaaatcaatagagaaaatcaacaaaaccgaaacctgacacttttaaaaagtccataaaatttataagcccctagccaagcaaactaagaaaaaaagaaggatacacattagtaatattggaaatgaaagagtagatatcacaacgggtcctatgaccattaaatggatgataaagaaatactaagagcaactctatgcctacaaatgtgacaatttagatccaatagaccaatttctcaaaagatacaatctgccaaaactcacactcacacacaaatgaacaatcttaatagactatagctattaaagaaattgagtcaacaattcatatgcttccaaaacaggaagtactaggcccacatggctccactggtgaattctaccaaacattcaatgaaaaaacgtgtcaattactacaacctttttcagagaagagtgttttttcctaattcattctatgaagccagcattaccccaataccaaaattaggcaaagacattccaaaaaaacaaaactacagaaagaggcaggtcaagatggtaaaatataaggttacaccaattgtctcctctgcaagcacaccaatttaacaactttccacacacaaaaataaacaccttcataagaaccaaaaaaatcaggtgagcactcacagtacctgattttaacttcatatcactgaaagagacactgaagaggttggaaaaacagtgttgaattaccagtgccacccctccccacatcccctggcagtggcaacgtggtgcagagagcatttctgtgaagcaggagagggagtgcgcagcaactgagaagcactgaactcagtgctgccccattatagcagaaagcaaaaccagaacaactcagctgatgctcactcacagagggagaatttaaaccagccgtagccagaggggaatcactgatcccagcagtcatttttttctttttttttgaggtggagtctcgctctgtagcctaggctggtgtgcagtggcgtgatctcagctcactgcatctatgccttccaggttcaagctattctcctgcgtcagcctcctgagtagctgggattactctccaccacgcccggctaattttttgtatttttagcagagatggggtttctccatgttgggcaggctggtctcgaactcctgacctcaggtgatctgccctccttggcctcccaaagtgctgggattacaggcatgagccaccgcgtctagccgatcccagcagtcttaacttgagttcccacaaaccttgtcaccttgggctaaagggacctgggcccctaaataaacttgaaaggcagtctaggcaacaaggactgcaactcctatgtgaaccctagtgctgaactgggcccagaaccagtgaacttggggggacacatgacctactgagataccagctggggcagctaagggagtgcaggtatcaccccttcccaaaccccaggctgcatagcttgtgcctccaaaagagacctcttccttctgcttgaggagaggagaggggagaactttgttttgcatcttggataccagctcagccacagtaagatagggcactggtcagagtcatgaggcccccattccagactccagctaccagatgacatttctagacatgccctaggccagaaagaaacacactgtcttgaagagaaggactctgtcatggcaagattcatcacccgctaactgaagagcctttgggccctgaataactagcagtaatactaacagactgcactgagggccttgaatgagacactgagacttgctggcttcaagtgagattcagcatgttcccagctgtgatggctatggggcaacattccttctgcttcagaaaaggagagggaaaagtaaaggagactttgtcttgcaccttagatactagctcagccactgggggggtagagcatcaagcaggcccttgaggtccccgattccagaacttggctcttggatggcatttctggacctgctctgggccagagtggagcccactcccactgggattccctgaagggtgaatcccaggccaggcagcaatgaccggaagctgacttagctcttggaccttaagggaagatcagcggtagcctggcagtgctcccctgtgttctggtggtggcagtggccatggggtgaggctcctctgcctttggaaaggggaaggaatagtaggaagaactatgtcttgtgatttgagtgccagatcagccacagtacaatagaactccaggtcgacttctaaggttttttactttagttcttagctcctggatggcacctctgaacccgcctgggcactgagggaactgatgccagggaaaaggcacagacatggctgggtttgccacctgctaattgtagagccccaggccttgagggaatgtaggtggtagccagggagtggttacagtaggccttgggtgaaacccagtgctgttctggcttcaggtctgatccagcacagtcctagtggtggtggccctagaagtactggtgtcactttatccccagctccagatggctcaaaacagagagagagagattttggttcttaaggagaaaatgaagagagcaaagtctctgcctagtaatccagagaattcatccataccttgtccaagaccaccaagttgggacctctattagtctacaagaaccacagtgttactggccttgggacaccccctaaagcagatacagtttagatcacaacacctaagtccttttgaatatctggaaagccttcccaggaaggctaggtacaaacaagcacagactatgaagaccagacagacacagacaaacatctgcaagtatcaagaccatccaggaaaaaaacgacctcacaaaatgaactaaataaggcaccaaggaccaattttggagaaagagaaataggtgtcctttcagacagagaattcaaaatagctgttttgaggaaactcaaagaaatccaagataacacagagaaggaattcagaattccatcagataaatttaacaaagactgaaataattaaaaaggattacacagaaattctagagctgaaaaacacaactggcataacgaataatgcatcagagtgttttaatggcagaactgatcaagcagaagagaaaattagtgagcttgaagacatgctatttgaacatacacactcacaggagacaaaagaaaaaaagaaaaaaacaatgaagcatgcctacatgatctagaaaatagcatcaaaagggaaaaatctaagagttattagccttaaaggagaggtagagaaacagatatcagtagaaagtttacttgaagggataataactgagaacttctaaaacctagagaaagatattaatatcaaagtataagaaaaatatagaagaccaagcagatttaactcaaagaagactacctcaaagggttcaactcaacaagaacagctcactgtcctaaatatttatgcacccaatacaggagcacccagattcataaagcaaattcttagagacctacaaagagacttagactcccacacaataagagtgggaggctttaacacccctctgacaatattagacagatcatcgagacaaaaaattaacaaagatattcaggacctgagctcagctctggatcaaggggacctaatagatatctacagaactctccaccctaaaacgacggaatatacattcttctcattgccacacaacactttctctaaaattgatcacatcataggaagtaaaacactgctcagcaaatgcaaaagagctgaaatcataacaaacagtctctcagaccacagcgcaatcaaattagaactcaggattaagaaatccactcaaaaccacacaactacatggaaattgaacaatttgctcctgaatgactcttgggtaaatcatgaaattaaggcagaaatcacgaagttctttgaaactgaagaaaacaaagacaacataccaggatttctgggatgcagctaaagcagtgtttagagggaaatttctaacacaaaatgcccacatgaaaaatctagaaatgtctcaagttaacaacctaacatctcaaataaaagaactagagaaccaagagcaaacaaaccccaaagctagtagaagacaagaaataatgaagatcagagccaaactgaaggagataaagacatgaaaaactcttaaaaaaatcaacaaatccaggagctagtgttttgaagaaattaataaaatagacaactagctaagctaataaagaaagagagaaaaatcaaataaacaaaacacaatcagaaatgataacagagatatcaccactgaccctacagagatacaaacaaacatcaaagaatattataaacacctctctgcacataaactagaaaatctaaaagaaatgaacagtgttctggacaaatacaccctcccaagactgaaccaggaagaaattgaatccctgaatagaccaaaaatgtgctctgaaattgaggcaataatggcctaccaaccaaaaaaaaacctcagacccagacaaattcacagctgaattctaccaaaggtagaattcaaagagaaggtggtaccatttccactgaaactattccaaaaaattgaaagggaaaggaatagaaggaactttttggaacacatcaaaaaaattgaagaggagggactcttccctaattcattgtatgaggccagcatcatcctgataccaaaacctgacggaaatacaacaaaaaagaaaaacttcaggccaatatccctgatgaacataatgcaaaaatccttaagaaaatactggcaaactgaatccagcagcacatcaaaaagcttatccaccatgatcaagttggattgatccccgggatgcaagtttggtttgacacacaaaaatcaataaatgtgtttcatctcaaaaacagaaatatagacaacaaccacatgattatctcaatagatgcagaaaaggcctttgataaaattcaatatccctttatgttaaaaactctcaataaactgggtattgggggaacatatctcaaaataataagagccatatatgaaaacccacagcgaatatcatactgaataggcaaaagctggcagcattcctcttgaaaactggcacaagacaaggatgccctctctcaccactcctattcaacatagtattggaagtcctgcccagggcaatcaggcaagaggaggaagtaaagtgtattcgaatagaaagagaagtcaaattatatttgtttgcagattacatgatcctatatctagaaaactccatagtctcagccccaaagtatcttaagctgctaaacaacttcagcaaagtctcaggatataaaatcaatgtgtaaaaatcgctagcattcctatacaccaccaacaagcaagcagagagccaaatcataaatgaactcccattcacaattgctacaaaaagaataaaatacctaggaatacatctaacaaggaaagtgaaggacctcttcaaggggagctacaaaccactactcagagaaatcagagagtatacaacaaatggagaaacattccatgctcatggacaggaggaatcaatattatgaaaatagccatactgcccaaagcaatttatagattcaatgatgttcccattaagttaccactgacattcttcacagaattagaaacaactattttaaaattcatatggaacttaagaaaagccagaatagacaagtcaatcctaagcaaaaagaacaaagctggaggcatcatgctatctgacttcaaactatactacaaggctacagtaaacaaaacagcatggtacaggtacaaaaatggacacatagaccaatggaatagaatagaaaactgaaaaataatgccatatacctacagccatctgatcttctgcaaacctgacaaaaacaaacaatggggaaagggtttcctacttaataaatggtgctaggagaactggctagccataggcagaaaattgaaattgatttcatttttatatagggttggaggtctagtttcattctcctgcatatggacacccagctttcactgcaccatttattgaagagactctcttttccctagtatttgttctcggcagttttgtcaaaaattagttggctgtaaatatgtggattaatttctgggttctctcttctgttccattagtctttgcatctgtttttatgccagtaccatgctgtttaggttattatagctttctagtatattttgaggtctggtagtatgatgcctcaagctttgttctttttgctcaggattgatttggctcttcagggtcttttgtggttccatttgagttttaagattttttttctattactgtgaagaatgtcattcatactttgataaggattgcatcaaatctgtagattgctttggatagtattgtcattttaacaatattagtttttctgatccattagcatgggatgtctttacatttcttttcttcaatttctttcatcagtattttgtagttttccttgtagaggtctttcacttcttttttttattattattatactttaagttttagggtacatgtgcacaatgtgcaggtttgttacatatgtatacatgtgccatgttggtgtgctgcacccattaactcgtcatttacattaggtatatctcctggatctttcacctctttagttaaatttgttcctaagtattttattttattttattttttgtagctattgtaaataagattgccttttaaatttctttttcagctagtttattgttagtgaataaaaatactactgatttttatatattaattttgtatcctgcaactttactgaatatcagttctaagaggttttctgctagagtcttttggttttgctatatataagattatgtcatctgcaaacagacaatttgactttctcctttccagtttgtatactagaagaaaacatagggaaacacttcaggacactggtctaggaaaatattttatgaatacgacctcaaaagcacaggctgaaataaacaaatgggattatgtcaaactaacaaccttccacacagcaaagaaaacgatcattaacggagtgaaaagacagcctactgaatgggagaaaaatatttgcaagctactcattcaacaggggattaatattcagaatatgcaaggaactcaaacatcttttttttccttgatggagtcttgctctgtcacccaggctggagtggagcagtgtcaccatcttagctcactgcaacctctgctttctgggttcaaatgattctcgtgcctcagcctcccagatagctgggattacaagcatgcaccacctggcccggctaattttatatttttagtagagatggggtttcaccaagttggccaggctggtcttgaactcttgacctcaggtgatccgcctgcttcatcctcccaaagtgctgggattacaggtgtgagccactgcacctggccatggaactcaaacatctcaacaacaaaaaaacaaacaatctgattttaaaataggcaaatgatctgaacagatgtttctcaaaacaagacatacaaatgatcaaaatacatgaaaaaatcctcaacatcattgatgtttcagggaaatgcaaatcaaaaccataatgagatgttatcttaccccacgcaggatggctattatcaaaaagacaaaaaaaaattgctgctgaggatgcagagtaaaggaaactcttatacactgttgatggaaatgtaaactagtatagtcactatggtgaacagtatggaagtgcctcaaagaactacaaatattactatcacaggatccaacaatcccactactggccatttatctaaaggaaaggaaagcaagtatccaagaaatacctgtgcccacaacttcattgcagcactactcacaatatccaaataaggaatcaatccaggtgtccaacaacagacaagtggataacaaaaatgtgatacatatacacaatggaatactattcaagtgtaaaaaagaatgaaatcctcttattcatggcaacatgggtggaactggaggatattatgttaggtgaaataagccaggaatagaaagtaacactgcatattctcactgatttgtggaaatgaaaaaatattgatctcaaagaaataaaaagcagaacaggggatactaaaggctgggaagagcaagaagaagggagagatagagagagattagttaaaggatataaaattgcagctagataggaggaataagttctagtgttctataacactgcaggatgatgataacatattatatagactcaaatagctaggaagagaatattgaatgttcctaacacaaataaatgataaatgtttgagatggaagatataattactctgatcttttcgttatatattatatgtgttgaaacatcactacataccccctgaatatatacaattgttatttttcaattaaaaataaaaataaaaaagacgtgcaaaaaataaataaaaaaagaatagccaaaatccagaacaacaccaaaagcaggtaaatatatggaacaagatatggaacaacatgaactttcattcattgcttataagaatgcaacattatatagacatttggaagacactttggcattgttttacaaaactaatcctaccatacaatgcaacaataatactcctttgtattttacccaaaggaattgaaagcttatgttttcaatcctttacacaaaaacctgcacacaacgtttttagcagccttattcataattgccaaaacttggaatcaaaagatgtccttcaataggtcaacagatagataaactgtggttcatccagacaatggaatattattgagcacaaaaaagaagtgaacgatcaaacattgaaatgatatggaggaaacttaaaagcacgttattcagtgaaagaagccaatctggaaaagctacatacagcatgattctaactatatacgacattctggaaaaggcaacactatggagacagtaataatgtcagtggtttctaggagtgagggtagagcaagggatgaatagatggagcacagagaattattaaggcagtaatctttatggtactataatgaaggatatatatcattatacatttgcccaaactcatggaatgtccaataccaagagtgaaccctagtgtaaactatggaccttgggtgattatgatgtgtcagtgtaggttcatcaactgtaacaaatatatgaccctgtgggggatgttgatcacaggggaggctatttatgcatgtgtgggggcagagacatatgagaaatctctataccttcttttcaattttgctatgtacctaaaattgttcttgaaaaaatcctttaaggcaaaaaataaatttaaaaaaatagaataaaaaactcctaaaccaaatttattcagatttctattttataacatttaccttaaatcctctgtagaaaaactaagaatatacattaataaataattctcatctcttcctctggcttctctaatttcttatcacttagatatttccttcagatgtcattttattcacatgccttcttaggctctgtttatctctcatataaaatcattgattaataatttgtgcacatatgtagaagggaagggaggtcttttcttcttcctcctatcacaacctctaatttttgcatgtagattttgtttggcttgtagatgttacttaagaagagcaaatctactgtgataactgctaccccatatcatacattacttctttctattcgtggtcttaactttgttggtgagaactctattttatgttttctgtatttctcttttcttttgcctactttactctgcaatatgccatattttaccttgtgggcatgagttccaaacaaaattcttcctggatgactgtgtgggtaccctacctaaaagcaattagttattgcaacccaaattaccaacacaatataactggatcatgctaatttttggtttagtactttactgtaggttattgaagctgtttggcattttaatttttcaaaatgcttcaggaggtttttgatcactttataataaaactttattaagcaagatacacatataacattattttacaaaagagctgagacactggcatgtggtttggtataagagtgaaggccatggcctctgaaatgggactacttgggtttgagctctagctttttcacttaactactatgtgagcttgaataaattacttaatccttctgtatttcagttattgatcttgttttgtaatctgtaaaatgggcattaaaatagtacttttagctcatagattgatgcatatgtattattactttggtgatttttaattgtcataataaaacagtcaaaactagtctgtagtaaacttgtacataattacatttaattgctctatcttcttgcctcatggctctttgttgttgaatttccattatccagagagagctgtcccttgctctctcgctctttacttggactttggagaacaacaacaaaaagctaccatgtgtaaaatgaagctaaaaagaagttgatgatttaaataaatgagcatgtttcttataaaattcaggaaggataaagaactccactcagttcattaaccagttactaaatggtgtttgcattatccacatgaatactaaatgaattcattatgatatgtgctattacagtgaatagcaaatgaactcataactatgggctccataaaaatattcctaatggagaagttatgcattgtcaagctgctttctagagtaactggggcttatattgaaatgggcaaaataaataatatgaggcacaacattggttagttggagttattttagtaggttctttagaactgaaaatacagtttatgtcttgataaaatgtcagtggcctcagatcactccattatttgtttatgtcctttattactgatggctgatgtctagctttgtctgtgattcaaagacaaagatacaattatatgcagctggtcaacaggaaagctttggtctgtgataagacagactatgtgaaaaagtcttgaagagtttgcaaccttttctgctcagagactatccaaagaaatggttagcacacttcatcaatctcaggtcagttgctatacataaaatccagtgaaccccctcatctgccaactttttctcagtataagaataaaataatttttagaattaacagcatgattggtgtacccctgaagtaatatttggattttattgaccatcataaatagattatgaaatcatggcagcaacaaaagcacagatggtgtcttataaacctgcaaactacaagtgatgagccctaagacgagtcagagggcactcgtgggccatcagtggtctagaaaccacactacacactatgataacctctcatttaaatgcagaattaatttcttaggaaaaaaatgacacagcatcttggtttcatggtaaaattaaaatacttcctgtgctgaattttcaagaatcaccagttttataagtaatcctaatctatggattacatttgagcctatgaaagtaaaatttagcaagaagtataaacagtagaaatagaaagtaaaacttcactaatgtaagcagtttaacaattcagataacattacttgcaggcccacaatgcccaaggcattatggggaatgcacaaataagactgtattagacttccagaaatttttaatgtagtctatcatgtacctatttaaacatgatatacattaaactggaataagacttagaaccaatatacacatatgcagtgtgaataatagcagcaaaataatagcaaacatgtacataacactttctatgtgccaggaactgttttaagtaagcactgtacataaatttattcatttagtacccacaataagcctgtgctgtgggccctattattatctccaatttacatgagaggatactgagctgcagatggttaagtaactcagaggtaggtaactgaccacaacattgtcatgctttacttccatgatggagggttgttgctgagaagcagctgctgcatgtagagaatgatgagattgtagaagaggggagagccacaagattcatgataccgtgagaaagaatttttgcagattagagagatcatggagcctagagaaggattttccaaaaaagggtttttttttttttttttttggtttgacaattagaacatcatggtgtttttaagtaagtggcacgtggaagtagtaggacatggaagttatttccagattgtttctagttaaggaaatacgagggcataaaaaattaaagatagtttttgaaaccttttttttttttaagaagtttggtcttgagtgccaagggagtagggatgaaattagttttcgggtattaaaaaagtagaaggagttttacaaaataagcatgaagtagatttaagagtgatcatcagagaagagtcaatggagggagagagactgaagataaaatcatcctctatgaaatcatatgcataccttctaagctactgttagcagagaaaattgataaaaaatacagctctttggttaattacattggctggatatcaccattttgtgagggtccatatggtttgtgggtcatcttcccagctcagagtcttcagatggtcaaaggatcaactttattttttgttatgatccacagaggaaaggaaaagagataatgaccaagacaaagaaagaagtgaacccggggagaaccttcagggaatctaagagaagagtttttttaagtttttcaatgtgtagaccattttaatatcgtgtcaatgtttcctgaagaagttgttggcggtctttaagattcctggactttcaccaaagagagtcttaaaacacacacacacacacacacacacacacacacacacacacacacgcctccaatcaatatcatagaacacaagagttgtagtttcaatttcctctattacttaaatatattatatgtattatggttcaagtacgtttgattattcttaactttgtgaaaacatggcattagagactaacttaataatgacacatttcaggaatgagaaagcttctaacacagcacctagtaaaatgttaaatgaattaaacacaattaaatgagatttgacacgcattatctcatttaacattcacaagaatcctgtgaagcagatgttattatcctgtcttatagttgaggaaacatgttaatggcatgcctaaaataacagaggggtaagaggaaaagcatggtcttgaatggattctacataacctactagtattttcttatgcattacatttgtttcatttgtacttaaaattgaaagtgtaaggcaagtataaacttcaaggtgctattaaaaattgtattttttagtgtaatgatgtctgaaaattgttcacaagtattttactatggcttacacctcagcagaaacagctctcagcactttcaaagtgggactattttatacagcctaaaaatgctctccaataaggcttcttagtagcaactccgctgacaacctcttgaatgtaatgttaagtaagacagaatctagtccgggcgcagtggctcacgtctgtaattccagcactttgggaggccgaggcgggcagatcatgaggtcaggatatcgagaccaccctggccaacatgtgaaaccccgtctctactaaaaaaaaaatatatatatatatacacacacaaattagctgggcgtggcggcgggagcctgtaatcccagctactcaggaggcggaggcaggagaatcgcttgaaccagggagctggaggttgcagtgagcagagataacgccactgcactccagcctggggacagagcaagactccatctaaaaaaaaaaaaaaaaaagaaaaaaaaaagaacagaatgtaaatgggaagaaatgttttcctgggagaaaaatgatactggtctctatttcccctcctggaggtaattgacaatcaattgcttaattgttctcagaatctttcctatttctaccataaatgtcacaataacagcacaaatgtactaatacaatcatttattcattcaacaaactctttttgagtaattattagtggctaggcattgggattatcatttttggatacaaagaaaaatagagtacagaatccattacctcaaggctcttgttctctagcatgtgtgtcttaggtatttaaacatatgttcacaggtacaaaatattgcacatagaactttaaaatgcataacaaaagaaatcatatttgtgataacttagtattatgctccaaactaatagttgtcacagattattcaaattctaaacctttccgggaagaagtgccgtatacagcacttctcttccatcctcgcatctcccttcccaccagtacaatgccttggacttacgtaaagtgtagatttactgagtgccagacaaatgcaaaattggcttttcctctgctcctttcttttacatgtaaaatgtagattcacaaagctaatcagaccctcacaagaatgtaaccacttgtctcattgcttacccactctccttttttgttcccctcccgcttgctctttcccctttaaatattgaagctcccaaaaccatcttttgaaaaagcactggtcacacatcctgctatgacttgcatttcttcttcccaggagtgtcttcaaccttggcaaaattaacctctaattgattgaaatttgcctcagtcactgttcagtttacaaagttacccagctcttctgcttaaatctttctcttaagctccctttaactacctttactggacttctctaccttgttgtttcttagacatctaaagttcagcatattaaaaaccaatgttgtggggttttttaaacataatgatgtccctttattcattgtggtacttcaaaaacaaaatacatacattattaagaaaataaaacacagcaaagcagaattgaacatttgagtactttttgcctcttccttttctcttaccagaaaccatctaaagaggtaaagaatggtaattgttttctagatatgttgaaaatatttttttcttttctttccaacttttattttactttcactgggtacatgtacaggtttgttatggatacattgcatgtcatgggggtttggtgtgcagataatgttgttatccaggtaatcagcatagtacccaataggtaggttttcagtgctcaccctcctcccaacctccaccctcaagtaggccctgatgtctattgctctcttctttgtcaagaaactcaaagtttagctcccacttgtaagtgagaacatgtgatatttgattttcttttccagcattaatttgcttaggataatggccttcagatccatgcatgttgctgcaaaggatatgatttcattattttttatggctgcatagtattccatggtgtatatgtatcatgttttctttatctagtccagcattgatgggcatttaggttgattccatgtctttgctattgtgaataatgctgtgatgaacatatgcatccatatgtttttatggtggaaagatttatattcctttgggtatatacccagtaatgagattgctgggttgaatggtagttttattttaagttctttgagaaatctctagactgttttctacagtcactgaactaatttacattcctgccagcagtatataagtgttcccttttctctgcaaccctgcgagcatctgttattttttgactttttaatagtaggcattctgactagtacaggatggtatctcatcgtggttttcattagtgatattggtttcagtagtgatatcatggttttcattagtgaaatgtggtttcgttggtgatactaagcatttttttcaaatgctcaatagtcacgtgtacatgttcttttgagaattatctgttcatgtcctttgcccacttttttaatggggttgttagttttttgcttgttgatttaatttccctatagattctggatattagacctttgttggatgcatagtttgcaactgttctctccctttctgtaggttttctgtttactttgttgatagtttcttttggtgtgcagaaactctttaattagatcctacttgtcaatttttgtttttgttgcagttgcttttggagtcttcatcatgaagtctctgccagggccaatgtccagaatactaggttttcttctagagtttttatagttacaggttttacgtttaaggctttaatctattttgagttgatttttgtatatgatgaaagggaggggtccagtttcaatcttctgcatatggttagccagttattgcagcaccatttttgaataagaagtcctttctctattgtttgttattgtctgctttgttgaaaatcacagagacatactaagtgtctgtctttatttctgggttctctaaccttttctattggtgtatatgtctgtttttgtaccagtaccttactgtttttattactgcagctttgtgatatagtttggaattgggtaatgtgatgcctcctgctctgttctttttgcttagggttgctttggctatttggactctttttttctttccaaatgaattttagaattttctcttctaattctgtgaaaaaatgccattcatagtttgacaggaatagcattgaatatataaattgctttggacaaaatggccattctaacaacattgattcttcctatccatgagtaggggatattttttccatttgtttgtgttgtctctggtttctttcagcagtgttttgtaattcttgttgtagagatctttcacctccctagttagctgtattcctaggtattttattctttttgtggctattgtgaatgggattgcactcttgatttgggtctcagcttggacattattggtgtataaaaatgctactgatttttgtacattgattttgtatcctaaaactttgctgaggttgtttatcagatctaggagtttttggagagtgattatgcggttttctatgtataggttcatactgtctgcaaggacagatagtttgacttctcttcctatatggatgtcttttatttctttcttttgcctgactgctctggctaggacttctagtagtatgttgaacaggagtggtgagaataggcatccttgtctttttctggttctcaaggtgaatgcatccagcttttgcccattcagtatgatgttggctgtgggttggccatagatggctcttattattttgaggtatgtccttttgtgcctagtttgttgagggtttttaacatgaaagggtgttgaattatattaaaagccttttctgcatctattgagatgatgaagtggtctttgtttttagtattgtttattttatgaatcacatttattgatttgtgtatgttgaaccaaccttgcatatcaaggataaagcctacttgattgtgatggattagctttttgatgtgctgctggattcagtttacttgtattttgttgaatatttttgcttctatgttcatcagggatattgccctgaggttttcttttttgttgtgtctctgccaggttttggtatcagaatgatgctgacccatagaatgagttagggaggagctcctcctccttgaattttggaattgttttggtaggattggtaccaactcttctttatatatctggtagaattcagctgtgaatctgcctggtcaatgcctttatatggtcagtagggttttttttttgttattattactgattcagttttggaactagttattggtctggtcaggttttaatttcttcctgtttaaatcttgggaggttttatgtttctgggaatttatccatttcttctagattttctattttgtgtacatagaggtattcataatagtcactgggttttttgttttgttttgttttctgtgtttctgtggggttagtcttaatgtcccatttgtaatttctgattgtgtttatttggatcttctcaccttttttctttattagtctagctagcagtctgtcaatattatttattctttcaaaaaaaaaacccaactcgtggttttcttgattttttatatgtttttttcttacctccatttcattcacttcagttctgatattggttattccttttcttctgctaggtttggggttgctttgttttcatttttctagttcctctaggtgcgatattatgttgttaatttgagatctttctaactttttgatgtggacagttagcaatgtaaacattcctcttaatgttgctttagctgtgtcccagagattcttgtatcctgtatctttgtttttgttagtttcaaagaatttcttgatatgtgccttagtttcattgtttacccaaaagtcattggaagcagatgtttaatttccacgtaaatgtatagttttgagagttcttctttgtattgatttctatttttattgtgctgtggtttgagagtgtggttggtgtgatttcagttttttttgaatttgttgagaattgctttatggctgaaagcatggtcaactttaaagtatgtgccatgttcagagcagaagaatttatgttgtgtgtttttgtgggggtgaagagctctgtagatgtctgctgggtatatttggtcaagggttgagtgtaagtcccaaatatttttgttaatgtttggctttgatgatctgtttattaccatcagtgtagtgttgaagactcccactattatttgtatggttatctaagcctctttgtaagtctctatgaactcgttttatgcatatgggagcttcagtgttgggtgcatatatatttagcattgttaaatctttttgttgaattgaaccctttatcattatgtaatgcccttctttgtccttttcaatcactgttgctttaaactctgttttgtctgaaataaaaatagcaactcctgctcttttttgttttccatttgcttgaaagatctttctccatccctttactttgagcctatgggtgtccttgcatgtaagatgggtctcttggagacagcatagagttgggtgttgcttttttatacaacttgccactatgcgccttttagatggggcacgtagcccatttatattcaagattaatattgatatgtgcagatttgatcctgtcattatgtttttagctggtcactatgtatacttgattgtgtagttgctttatagtgtcaatggtctatgtacttaagtgtgtttttgtgtgggtggataatggtcttttgcttccaagtttagcactcctttaaggacctcttcttaggcaggtctggtggtaacaaattctcttagcatttgcttgtctgaaaaggattttatttctcctttgtttgaagtttagtctgctggacgtgaaatccttgactggagtttattttctttaaagtttctgagtataggcccagtctcttttggcttgtggggtttctgctaaaagggtccactgttccatttgtaggtgacctgcctcttctctgtagctgcctttgaatttttttctttcaagtttaccttggagaatctgatgactatgtgtctgggggatggttatcttatacagtatcttgcaggggttctctaaatttctgaatttgaatgtcagtttctctaaagaggttggggaaattttcatggacagtattttcaaatatgttttccaagttgcttgctttctctccttctcttttaggaatgtcagtgagtcataggtttggtctcttgacataattccatatttcctggaggttttgttcaatttttaaaattcttttctctttattttagtctaactgagtcacttccaagaaccagtctttgagcactgagattctttcctcagcttaatctattctgctgttaatactttcaatcatgctatgaaattcttgtggtgagtttttcagctctaacaggtcagtttggttctttcttaaaatggctttttcatctttcgtttcttgaatcatcttactaattccttaaattccttggattgggtttcaactttctcctgaatcttgaggatctttgttgccatccagattctgagtaatttcagccatttcattctggtcaagaatcattgctggggagctagtgtgatcacttgggattaagaagacattctgacttttagagttgccagagttcttgtactggttacttctcatcagagtggattcatgttccattaactgtggtgaaatttgagtatagtcagttggctttttttctggatgttttcagagggccacagctttgtgcagggtctttgtggctgagttcttgtccttggtttcacagatgcatatattagcaaagtatttttggtgttgaagtctggactgtggtccagtggatggtgcttcagcataatgaccagtagaaagactcttactcagcctatgtctcctctgtatttctttgtgtttgcagccatgctacctctaaatgctctgaaattgtgggctcctctcccactcaagtgctggccatagatctagacttggcactcccaggcttcacactacatccctggggtgagttaaggttttatgttttctcttcaacttggtggcaccagggtcagggacctttgcagtggcaatggcagaggaactttcagttatctcttggggcaccatttccaccccagagaaatgcagagccactgccaatcagaatgatcagctgtgggtggggtggctgtgctgtgaacccaagctgtgggacccttcctggtgaagaccaggatggatgggggtctcatggggaagacagtctggcctcttctccatatggtgagtgcaatgtgctggaggtatgagtgaaacaccatggctctttgttccttccccagcccaagggcaacaagagccagtacagctgcagcagcagtggcagaggagttatcagtcgcctctgggaactccactctagagagacacagaagggctgccaatgggaaggttcagccaggagtgggcctgctggagcagggggtcaggggttcacaggaaagagaaactgggctcctttctgtatggtggctgcaatgtgctggaggtgcgagcaaagcaagcaggttctttgttcctcaacccaagggcagcaaagatggtactactgcagcagcaatggcagagaaagtctgtgggttgtctctgggtattccactccagagaaaagcggagttgccaccaactgaagttatcaagtgagggcagggcagctgggctggggactcaggtgaggaggccctgcccattgaagagtagcaggggcaggaaccctcatggaaaacggtctggccacttttccataaagcagctgcagtgtgctggaggtctatgataatagttcttaggcttttttttgttccctccccagcctgacggcagtagggatggggcctgcagcagcagcagcaaaggctgcagtcctgttggttacctctgggagcaccaacccagagaaatgcttagctgtgaccagttagtgtgctctgaggggatagattagctgtgcttgggtcctagggcagtggcctttgccggaggaggtgcagtggaggcaaggtctgcagtctgtccactcctctgcactgtggatgtggcctctatcctaaggatgtgcatgagagcctggcctcccttgttggcagggctgtggtcccgggtgccagggagcccagggatccaatttccttggggctgtacataggcctgtgctgcggctctgcccagactctacccagctcttcgtttcagtctggagatcccatggagaggcagtaagggggtatctcctgtgcccagggttgcaaaggtccatggcagaagtgtaggtctctgggttctctcgctcactcaccctttccctgcagtggggagcctcccttgcctgcatgccaatcccagatgggtggctgtactgccttgttcctctctgctctacatgggtcccttggcttccctgatgaatcccaatgtgtccctaatgttgttatttctctcctaacttttcccttatcctgtgctcatgattattattgaatacttgctccccaaatatcactagcacaatgtgttgataatttaaagttcagttcattatttaccgaagtaagagagaataccaccttgatagaactttggcagtgtgtgggaagcgggaaagcaaaatttgaatttgttgagacttttggtttaagatgggtgttttaatgtggggacttgattaggattcggtaagggtcaccatacaactgtttaggattggtggaatcggcaaggtggggatttttgagggaaggaatttaaagaattctagggtacaaactgttgatgctttccattgaagactttagctgtttccagaaagttttctcatgcagaatcaagtcatttgtctgaactaaattctcctgcaattgtaaagtcttattaatgatggcaatagaaaagtcatgctgatattgtgcgtaagttaggtttggaggaggaagtgggtagtttccatccacattgattttggacttctagcttccagaacaagaagacaatacatttctgttattttgaaccatccagtttgtaatactttgttatagcagccataggaaactacaactaatgttaatgaagcaggtgactacacatttttttttaacaacaacaacaacaaaattacctcctattaagaataaccacaaaatcatcaaactggattctttcaacatgtatttattgagcacacagtgtccaatctgtgtgtggacgtacatggtttgagttctcattatctacaaacttgcttgaaacaactgggcagctgatggttatgtgaatgtatacttgcttcatatattcactgtttaagcctcgataatattagacctctcttgtaatttcttagaagaattcattcacaaatgatcattgctaataaaaattccttttaagccgtatttaattggatgacacttagcttgaacacctaacagcgaattatatataaccccatttgtgatcttctccatgcacaactctttgatcccccatttacatcaggtacctaactgtataaaactatccatgacactctagggcactgctttacctgtattttgcatgggcattttctgtgattggctgaataatctttgaaggcagtttttagcatactagctgcagaacagacaataggagcttaataaatacatactgaaagaacccagtttgatgattttgtggttattcttaataggaggtaattttttttggttaaaaaaatgtgtagtgacctgtttcattaacattagttgtagtttcccatggctgctgtaacaaagtatcacaaactgtgtggttcaaagtaatagtaatttattgtcttcctgatctggaagctagaagtccaaaatcaagttgttctcaggaccatgctgctcctgaaacttgtgggtttgcctcctcctagcttttgatagattgctggcagtccttggcattcatgagcttgcagctgcataactccaatctctgcctttgccaccatggcattctccttgtgtgtgtctgtcttcacgtggccgtcttcttatattgacgccaatcacattggattagaggcccagtctactccagttatgaccttgttttaacttgactgatcacatctgcaatgaccctagctccaaataaggtcatgttctgaggtactggtattctgaagtactttcatgtatctatttttgagaaccaattcaacctataacactgacttatataattcacttttgaactagaatgacaaactattggcacctagtgggtgccacaaaatgatattcctttccttccttcttcatgctgggttataattacagtgactattcatgactgatttctgtctgtcccagtgcctttatgcttgtcagaaggtgtgcacgcaatgtggtgaaaattgggtcacccatttacctgttgatcctcatcaactggcaggtggtttctgaggacctgggctttttaatgctattcggtgatttttcttagagaaccatcggtctgcccctcatgcagtatgtagccactgctggtttctttctttgtcattttgtacagtcttgctgcactccctcctacaccacaatatgcttttgtgcaaggagccagctcatttcagggagaggagaggcgtccagctgcccatggaccccaccaacaccagctctgacataggaggggaaacagccccgagaggtgcaaagtattctaagttatggatgttcatagaagggtagtttgttttatttgtaattctttacttttggctgtgcttacctcctgccagatttctaactcccttaacatttaagattgccaaatcaggccatctgtaaacatgaaaagttgtaaaactggggtctttcaccaaagtgatagttttaatattctgaacagaagaaaaactaatattttagttctgaaagtcccaaataatatagtttggagtgggtatagcctctctgttctccatcctctgcatttctcagggttttctgaatgtgggtggatcttggtttgatggccatctttttcttcctctctgtcgagaatgtgccttggcaagcattggagaagcccagcacagcttttgtgagccagaaaggttaaaactgagctgacaggacagccccagctctctgctgttggtgagttattctgtttattctacatatgtttccttttaattaaaatgtcatttttaattaaaaatgaaatgtcaagaaggaaaaaaattggcaaagtctggatgattgcaatgaatgcaagcaggaatagtcagtagagagaaataactttaaaagaacgagactgtatcttattcaccattttggttaaaaagaaaaaaaacaaacaaaacaaaaacaaagagagctttggagggttttgaatgctctctgctgttcatggcaggcacacacacacacacacacacacacacacacacacacacacacatctgctttatagcttgttcccataattaaaaaatatatatttgatgtgtgggcacatgctttaagttaatgaaggatgctgatgggtgccacatctttcatgagtgacagagccactaatgagatgtagcattgactgtagagggcaccaataaattgtgtaaaacacccctgctggccatttatttaatttattttatggaagcataatgccttatagtttaatatggagcttttattttgttataaagacccaagtctacaatggggttttcaagaattatgcatcatttatgcctcccatttcagcatggcactgatagagaatattctacattatgattaaatcctcaaagagatgcttctataggcaaaagcaactgcactagagtttacattatgttttctgcagagtgggaactgacacgtggttaggaatgtggtggggcttgtagaaatcagttgcagaagagcaacgaaaggtagttttggtatggaataaaggaaagaccaatgagaagtgagcctctccgcagcaggtagtgtcttcatttggtcttccatctttatctttttatgccttttttgctcttttgatcatgctgagaaacttcctctccctctccacatttggcaactttgcctcattttctttcctgtatggtgccattcttttccctgacttaggtctttgcttatgttctttcctccgacatgtaatcatcccactataccctccatgaactccccacctaacttctgctacttgctctttgaagctctgtttatgaaatcagttctcaacttcaatgatttctatcctgtaatgacattttttcccttccatcagtaagtcctgtgaatattctttcataactccctggacttcttccttgtatcacttatagcacctgtaattaaatgcttaattgccaactgaatttggttacattttctagaatgtaagctccaggaaggcagaaacagtgcctaccttgcttatagctgcatccctagcacctggcatgatgtcttgtacatagcaaatttcagataaatatttgttgttgattaaatatttactctcagtaaagactgtaagtatttggttagtatggtttgcttaaaagcaagtgaaaagtagtacaggttcatgaaaattgtgaaagggctttataaaccattatacatacctccagtttagctctctctccaatcctgcttgcattctgtgaaaatgaaactaagaattagagtttgattctcataatgatacagaaaaaagctgtaattttatggaaacataattcaataaacctatactgaaagtctactatgtgccagacagagtacttggcacctaatgtccctacagttaaggagctttcagtttggtaaaatttgttgagcaagtaagaattgaaaaacatttttatctacattggctgtcttttgtatttccccaccagtaaatgttatgtaaaggaagcccagttcttacaatgtatatgacaaaatatacttgtgtctatctacaaaacaaaaacctgaaggaaattgaaatgctattccttgtttgctctattagtttattagtatgaaagtattactttattgaaacataaaataaaatggttgaaatgatattgtgtacacattattttctgtctagtactcaattttgtaaatataagtagtaaaagtaaagacatctcttatccatttcactagatttttttacagttatctttaaacatttattggaaagattcccccatttttctttatctccatgatagtcaagaagttctgctttgtgtccagttgaaatatcttctgctttattaaaccaatttctgcttgtttgcacctctgtgtccatggagaacaactgatcagcatcctttatataaaaccttttatattcttggagacagtaatttcctgtgaaatgtttagttgaaagttccataaacttgaagagaaacaaaagggttgtggttactttacacttcatgaaaatattgttgcaaagctttgaatgtaaagacagttacatttacctttctatgtgacaaattaactttagccccctttttaatcgcattttggtttcatcatgatacatttaaattatgtatttcctggcaaatgtggttaattattttggaagtgtatgcacatagcaaccctctttggtttctcttaatttctcggtaaatctttttgactgtattttataatttaaatttataattgtcccaatatgaattattattcatttggaattgattttggcaatttgattctaaaaccttgaaatctaataatggataaccactaagaaaacattctcatgagatatagaaaaaaaatttagggtcgagtgatttaattgcacgaataggtttttttatttagaaaatgtattattcctatcattaatttcaatagtccataattgtccacagtagtttaagaaattcaaacaatatttatgtaacattaaacccaaaatatcactgaaactgcaaacatttatgtggcaatattaatgtgcagacattttctgggattgacagcacacgggcacatggtattaactatctcataatttcttcattctttatgtcaagggagctcttcatggaagttctatgattggagggggtctctatatacattagcacacttctgcccaagtgtttccttggttttggtgaaaggctgccctcttgtgcagagatgagaagcaactgttaaaaagcctcatttagcttattagctgatgcaatttctattggattctaaaatggaagttaatgctatgcttggaacccacaagtcatcttttaaaaatatcaagaatttactcttaaccttcctctggactctttgtaccttagcagggattatgattctcatgattcctccatatgactcagaccgaagataaactctcaccttcaattcaaggaaacagctccccattaggaacagcctatagagttttgctctcaacaaataaatgatgtgtttatttctaattacaaaacattctcatctattactgaatcatataacttaatgaaaaagaaaccagacccactcctttgggtctattgaagtctaggtcttagctttgtcaccgctggaagagaagaaacttgaagaatccttcacaatgttagtactgagaagtgaaaaatagagtgccactcacttctactgttttaggtcttatttatctaagcatctaattgaattgaagaagtagtatttcaaaaatgtatatttgataagtaggtaagatagattattctatctgagactttagtaagttttattttatgtaaatgctttcttgtactttttaaatttagggttttaaagagcttcaataattattgtcacttagaaaagaatgagttgaatatcttcatgaaagttgtaagagtggctaagaaccctgagcaatggtgtctgaattaatcactctgtctctaacgtataactcacagaatgtaaaagtaaagctctgatgtgattatagtttagaattccacaaggtctttggtcaccagagtatgtttgagccccacctttttattagataaggatgacataaaaacaaacagagcctcaaggaaaatgaaaacatgtgtccccacaaaaacttgtacacaaaagttcatagcgggattgttcataatagccataataaccaaaacgtggaaacaacccaaatgtctgtcagtggacaaaatgtgatttatacatacaatgggttcttattcagccataaaaagaaatgaagtactgatacatgccacagcatggatgaaccctgaaaatattacactaagtaaaaaaagccaaacactaatggctatataatgtatggttctatttttgtgaaatgtccaaaatgagcaactctatagagatatgtagattaatggtttcctagagttggggtgattggggaggggaggagaggggaaaagaagacaatggtgacaatgggcacaagggttttttagagaaggaggtgataaaaaatgttctaaaattgattgtggcagtgattgcacaattttgtgagtacactgaaaaccattaccttgtactctttaggtgaattttatggtattagaattatatctcagtcaagctgttctttaaaaagagtaaaaaaagtaaataaattaaaaataaaaacctcctgtgttctgtaaaaagtcttttccttatttcaatggttggtacaaagtctttattcagtactgaaaattattcatatgtgtgcagttagcctcaccaaaccattcttggtttaaagattttatgtctgattcaaacctgctttcttgttttatgagtttaattattatgaacaatcttctctcagacttttctcccccctcccaggacaacatgccttggagggaatgtaaatattttacgtgttgttacaatatttatatgagcagaaacaaagagttgagggtggcactttccctaatgaatgccagcgctggctttgggatcagatctattaagattcaaatcctacttattcattgtgaaatcttgtacaagttctctttgaacgtcagtttccttcaccataaaatgaggatagcagtaccttcttcatatagctgttgtttcatgtattaaatgagataacatattttaagcactttgcaaatttacttagacatgataggtgttcaaaaaatatagaaattaataataataattttgaagaaaataattcaatttatttaaagataatccttatttagctaaagtgtatgaatagaaaacagagttaacagattcctcaaactatttcaatggtaattagggaatttttgcattggtctttaaaagtatgaatatttatagagagttccttattaagaatcattttttttccttcaaaagaaaagccagatacaaacaagtagggaaccattgtagcttttggggaatgggcaaaattattatcttgaggtattattttcaaaataatggattttacttgtcgtaggacactttttctgccttttcatcacaattgcaatcagcacactacctgctttcagcagcaacagaaacagctggatcacccattttgatgagggattactcttcagtatttatagtaacacccatttcaccaagtagggctcaaaagaaggaaaaaacaaacaactgacttctcttgtaacgggtaactgctttcttttgtactaaattttctttcctattgctttcactagcttcagatcctgaagctcatttcgccactcaggggacactaaaaagcagccaaaccaacacagccaatagaaatttaatcttaaaaacataagactttgctttgaaaatcctgtagaaacattaagcaaaatattaaggaataaaaacaagcccatgagcatggcaaaggtcttgaaacctgaacagggactacattctaagtcagacacgcataaatatgtgtcttttctcactgatattaatgaaacggttaattctgttgtcatggcaacaaagaacagctgtgataaaaagctaaaggtctacacataatgcccaatacaaggtctctaattctaaagctgattttcttagctacaatagaagtgatgtgttttcaatatcattctaagctttcacatcaaatccttctagttaatccaataaatagaccagtagcataaaaaggaatatatgtttgcacattataaaccttataaaagaagtttacctatgtccaatgttaagaggggatctgaaaagtaaatatatgctccttcagaataaaaacctactctgagtgaaaccctaaaatgtagaatatgtttgaataggatatcaaggtaattatcaaatgcactattatctagctagtcagtaggaatgtattatatttgagataacaacatcactgctactaccaacagcaacacaacagcaacaataattcaattttaaaaactcactggaacatagtaatgtaagtggcagagtttgttctataggcctattaatgttgtttataggtccactgcaatttgccaaatatattataccagtaatccaaccctggttgtagatgaatttcaggctctgataaagactcatgtaatatttcagcttcattgatgaatctcttccttaccttctttttggccctggaaggtcacctagatttctttgtcttcctcatctcccttcttcataggtctctacaagaactgtcctccctcctctattccatattcttagctcaggtactcacagtttctctcctggattactgtgatcgaacaggcctccaattcattctccagccaaatgtcaaagtaatctttctaaaacataagtgaaatcatgtcccttctcttaaaatctttcagatttcctcccttttctgtctgagaaaaatcaaaagttcttagtatggcttagaagaggcttcacgtgaaccttagcaacttcaccctcatctcctctgatgccccacttgctctgtagtcaaaaagaccttctgaagttttctgaatgggcattatgtttacgatttctatatcattttatagctgactgtcctttactttgaatgtccctttttgctttcccatgtaatgatttccaatttgtagttgtaaatttaactcatattttcaagggtgagcaatatagtgctttatatataatagtttttgaaaaggtcaaaattaaaatattccacagttaaataaattgtagcacagccataatatcaagccattacacaccatgctagagatacacatgtagtgatataaaaaactattgttgctcttttttaaggttattattgggttaaaatcagtatatgctaggtgattcaattttttcaaaattaactttattgatgtatagtttacatagtataaaatactcacatttaaaaagtacagtttgatggtttttaaaaaagtgtatactaccacgtaaccacaatcacaatcaatatatagaatattttctgctattcccttctagttattcctcatgttcatccctggccccaggcaaccactgatttgacttctatcactatagactagattttttttctggagtttcacatgaatggaacttagagcatgtttttttgtgtgtgtctggattttttcttttagcataatgactttgagattcacccatgttgtcctgtgtaccagtagtccctttacttttattggtgattcgcatttgatttggacattcagtaatttattcacatgttgatggatgcttgggtcatttccggttttggcctatcatgaataaaacttctataaacattcaagtacaagtctttacatagacatttgttttcatttctcctggataaatatgtaagagtggaattgctcagttgactggtgtcttagttcatttgggctgctataacaaaaatactatacactggatagcttaaaaaacaaacatttatttcttacagtcctggaagctgggaagtcctggatcaagacaccaatagatttggtacctggtgagagctctcttttcagtttgtagatggccatcttcttgctgtggcaagggacaaagggttctctctggggtctcttttatcaaagcataaatcgcattcatgaaggctgatgtggtttggctgtgtacccacccaaatctcatcttgaattgtagttcccataatccccatgtgttgtgggagggacctgatgtgaggtaattgaatcatggggtggttacctccatgctgttctcatgttagtgtcttgtcatgagatctgatggttttataaggggctttccccttttgctcagcacttctccttgttgctgcaatgtgaagaagggcatgttttcttccccttctgccatgattgtaagtttcctgaggcccccctagccctgtgcaattgtgggtcaattaaacctctttccttttaaattaccctgtcttgggtgttttttcatagcatcgtgagaatgaactaatacagtaaattggtactagggtgtggagtgctgctgtaaacataccccaaaatctggaagcgacttttgaagtgggtaatgggcagaggttggaatagtttggagggctcagaagacaggaagattgggaaagtttggaacttcctagacacttgttgagtggctttgacctaaattctgatagtgatatggataacaaagtccaggctgcggtgctgtcagatggagatgaggaacttgttgggaacagcagtaaagatcagtcttgccatgcaaaaagactgtcaacattttgcccctgccctagagacttgtggaactttgaacttgagagagataattcaggatatctggtggaagaaatttctaagtagcaaaacgttcaaaaggaagcagaatataaaaatttggaaaacttgcagcctgatgatgcagtaggaaagaaaaacccattttctggagagaaattcaagccagcagcagaaatttgcctaagtatctgggagtcaaatggtaatcacaaagtcaatggggaaaattcagaagcatgtcagaggtcttcacggcagcccctcccatcacaggcctggaagcctaggaggaaaaaatggttttgtgggccaggcccaaggtccccctgcagtgtgcagccttgggacttggtgccctgcatcccagctgctctagccatggctaagaggggccaaaatacagctcaagccatagtttcagaggatgcaagccccagaccttgacagcctccacgtggtgttgagattgcatgcaccaaagtcaataattgaggtttgggaagctctgcctagatttcagaggacgcatggaattacctggatgtccaggcagaagttttctgcatgggtggagccctcaaggagaacctttgctagggcagggtggaagggaaatgtgggataggagcccccacacagaatccccactggggcactgcctagtggagctgtgagatgagggtcacttccttccagactccagaatggtagatccactgacagcttgcactgtgcacttggaaaagctgcagatactcaatgccagcccacgaaggcagctgggagggggttgtaccctgcaaggccacaggggcagagctgctcaaggccatgggagcccacttcttgcatcagcataacctcgatgtgagacatggagtcaaaggagatcatttcagagctttaagatttgactgtcccattggattttggacttgcttgggcactgcagcccctttgttttggccaatttctcccttttggaatgggtgtatttacccaatgcctgtacccccattgtatctaggaagtaactaacttgcttttgattttataggctcatagttgaaagggacttgccttgtcttagataagactttggacttagacttttgggttaattctggaaagagttaagcctttgggaactgttggaaaggcatgctcgtgttttgaaatatgagaacatgagatttgagaggtgccaggaaaggagtgatatggtttggctgtgtccccacccaaatctcatcttgaattttagttcccataatccccatgtgtcatgggagggacctgatgggaggtaactgaatcatgggggcagatacctccatgctgttctcgtgatagtgagtgagttcgcacaagatctgatggtcttataaggagtttttccccttttgctcagcaattcctcttgctgccaccatgtgaagaagaatgtgtttgcttccccttccaccatgattgtaagcttcctgaagcttccccagccatgcagaactgtgagtcaattaaaccttttctttataaattactcagtctcaggtatttcttcatagcagcatgagaacagactaatacaaaggctctaccctcatcacctccagaagctaaatcacctcccagaagcctcatctcctaataccatctcattgggggttataatttcaacgtacaaattttgggaagacacaaacattcagcctataagaattggtcagtatatgattacagggtactgtcaaattgtttttaaaagtgattgagtgattttatatcttctcttggtgaatgtttgtttaaatctttggccactgttaattttcctttttctggagttgtaacgttttagaatttttttttctgaaaataagttctctgtcttatgtttgtatcactcaatattatgtaatattttctccctgtctatggcttcctctttactttcttaatagtttcttttaaaaatagaaaggttttgtgtgattatatttttgtaaaaagtgaaacatagacatgcacacacccctttgaaatacagaaaagaacctggaaagatatacacatggtacatacctctgggtaatcaaagtgattacctctaggtggtataattatagttcatttaaaattttctttttttcccctaactttccttaatatacatgaatagcttttataattcaaaaaatattacatgatatgtgaataacattataataattatatatatatatcattaagtgacactcctccgcttcttgatcttctgaatgtgtctttctttcatctttgtattcctggtgactgtctcagcatctgataaaactggtgcacaatataatttgatcaaattcatttagcaaatatttattgagaacctactatgtgccaggaatgtactgggtactgggaatgcaaattgtatatgaaacacagatctcgcaaataagtaatttacagttggataatctctctattgcctatgcctattataatgcctaacacttactagctacttgaaaaatgtgtcaatgaatgaaatgaagagattgtaattgagtcttgtatttcttagcatgatattttttcccagttatattatctatttatttgacactgattttttggcttatctattagagttcagcatgaacaattcaaataaattgtctgtacaaagggttttgcctgaaatggccgaatcaagtgggatataattctgagccctctgaagagctgatgaattttaaaaagagaggtatagggaggggtttggaagatgaaaactttttcattacgtttttctaggtgagctcatcttaaataaaagtagagttcgagtcatctgcctggcatggtaacattttcctttttattagaagtggtcagatcagatctcaagtcacttaagattatcttaattattaacatgactacaatcattctttacatagatgttgcatatgtattacttggtcattagactcaggacaaacagtgtcatccacataatcaaattgaatgatttcattctctggctccaatctcatgatactattaaataatttcctgtgaaatatcaactaccaaatattggatatatttttgttggttactatgtttggtaactgtgtatgatattgtcagctatggttactgtgtttgaacctttttctaataagggcaaatagaaatggtgattgcaagaagtctcaagacctgtgaataaggaaaataattgttctttcagcagatacattctagttagctacattcatgtgtaaatagaataaaaggggggcagggagatattactgcataaattgaacattgactacctttttagtagtggaatgtctttttttataagctaatatttgaagggcaggatttttgggtgttaagcagttatgactggagattaaagcacatttattttaattttatggtggcattccacagggtcagaatttttgcaaatgtaagtttcattctgaattttacttctatcttctgctttgaggataaatcattacctgtaggtggaaatatataccttaacacatttgataatgactttggagcaggaaaaaaccacttttttgagtacaaacataaaaaattctcataatgtttagcttttctagacagaaacatgtttctaggaaacacaagagagttgtctaattatttgtgagttccgaactgcttgtcaacttatgttaaattgaactggagtcatcctttaatctgatcaataaattgccctattacatttactaaacattgctggctagctcatgatcactgctttagtccttttacagggcaactgattataaagttcctttaagcaagaggacttttcttacactttctaatttcatccagtagttgatgggaacagtggtggaaagtctgtggagacaccagtgaaatttgcctgttttagttctatataagagaactccgaaagggagacaaatgttttccatatggttagaaattgctggaataagtcaatcaaccacttggggaaaggtggcttctattgttctgctatagtttcctctaaaacttaatgatcgaagagcagtttttggagggaaggagtgacgtagatttctatcttcaacaattaaaaaccagtaagctgagaccacagtctaatccaactgtaacattaccatctcaccaataaagtcagggtttgttaaagtttctaagtttgtaaatttgtaaattaacgtttgtaaatttgtaaattaacctatcaatacctcaatatccttatttgtaaaattgagataatcctagtatctatgtcattgacttattttgcagttccatgaaatcatgtaaataaagctgtcagggcaatggatgacacataatggcagaataagtattaataattattattactgttagtaccattgttactgctattatttcccacttttattattattactattactgatatc

SEQ ID NO: 519 - DNA, 12543 bp, Homo sapiens
agggcaaactctatgtcctctaggtcttcgtggttgattggatccctgcccacctctttgtcccaatcactaatggtcagatggaacacacccacgtagccataaagattgttagaacattgaaaatacttccttatcccaagcacacctacaccaaatgttccctgacatcctccctcctcccccagcaacctgtcagaaccccccacaattcagcaaccaaaggaccaatgtctgaccaactggatcccctaggctctgcatatgcaatattttaaatagtcccctgtccagcatcatcctttgccaggcttctctccctgctccagccacaccagcctttgccctgtctctccgaatatgctgttccctctgcctggtacttgataccttccactccctgcccagttatctctgacttatccttcagatctcccccaagtgtcactactacaaggagttatcataagagagggtctattataaaagccagtttggttctggtttttgcaccccttagccatgtgatgccttgtgccaccttgggactctgcagagagtccccaccagcaagaaggcccttgccagatgcagcccctcgattttggacttcccagtcttcagaactgtcccaggcttttctgactcccttttgaatggttctcttcatgctatgtgttacttctgtggttctaatcacggttgtaattttacattgtttgtgtgattttttaaaaatcagttttccagtgctaaactgtaggcttcatgaaaacagagagattgggcctgtatgttttatctccaatgcctatcaaaatactgacacatagacacatagtattccttctcccttgagaaggggaatggaggagatgcataagagccatttataggaatgtcttaagtcatagacaaaaaaaacaaaaaaaattacatcctacttcaagatcatggtgcctgaaatcccaccaccagtatgattctgtaaggttggacatttttggtggattaccaattaagcccaaaaccccattttccatatggagaaatcaaggcccaggtagataaaatgagttttccaaggccatacagtaattagtgacagaatcagggttcttgactcctagtccagtgctttttccactccaccctctgctattctttcttcatcccaggaattacttccaatgtccaaacttctctactgtaaatatccttccttctcattcccttcctgcagtctattttctacacaacatgtattagacagaatggagttgggagccatggagaagagaaatctatgcagccaatgaggaacagaggcaagatcctttaaccaaaggtcctccacctcaccatgatgcccaaaaggaattagcctaagtttgttctgccacaacacacgtggactcagtcaatgacagcctactgatgcaaggtcaagtgcaatcttcttagcctgacatgtcaggccttagatgatctggcccttgctctgtctccaccctatctcttgctattgcaactcatatcccacattgcagtcattctggactggccttaaccctattctcacccctctgatcctttatgcatgccacttctcctttctaaaaggcccttctcttaatctatcaggccaactaatagccctctgtcctttggggcctgcctcaggaatccccttatccaggaagctcttccaaccttcccccaaattaggttagattgggttgcaaacccactgcaccctgactcctggcctctcactactcaaccatgagatttctgaggacagggaccttgccttgggcatgctgtgtctctgatgctgaatcatgtgatgcttatgaagcatctaccacatgttaaatgcatatcagacatgggctgccatggagttaatgtttggcccctctgaaactcatgttgaaacccaatcaccaatgtcgcattatgaagaggtgggacttttaagaccctcattgggtcatgagggctatgccttcataaatggattaattcactcaaggattaatggataaatggattgatgggttatcagaggactgggttggttatcacaagagtgtgtctattataaaagccagttttgttttgaccaggaagtgccatgtgtcacttctcttcacagctcattggccagaaccagtcacacatgcaattgctatccatgtgatgccctgtgccacctcaggactctgcagagagtctccaccagcaagaaggccctcaccagatgcaaccccttgattttgaacttcccaacctccaaaactgaaagaaataaatttgttttctttataaattgcccagtctcaggtattcagttgtagcaacagaaaacagactaagacactgggggtacaatgatgaatacaggtctctgttcttgtggagtttactgtcagtggatgagacaaagagtaaatatgttagttagttagttgcttacttcatttgttcattcattaaatgatagattgttattagtgtttaaaataaatagtgtgtgatgacagaaaataatgggggggggagggtgggcaactctggatagagtcatcagggagtcctctctgagaagggtgagatctaacctgagacctgaaggataggaaggagccagccatgagaccaaccaggcagaggaaatgcacaggcaaagaccctgcaaaaagaaagagcttgttgagtctgaggcagagtaagcagctcagtgagctaggggctgatgagatgaggttcaagagggaggcaggagccagattacacagcaactcagtgataagtgcaacaggaagccattgaagaactctgatctggctgctgcgtaaagaatgaatttgggggatacaaaggtaggagtagggacattaattaggtgactattccacaaaatttggcaatgatgatggaagttcagactagggtagcaggagggagaagaaaaattgtgtgaagataaatctgatatctcagtagttaagtaacactcaatacatacagagtttattttttgcccacatgagagtccagtgtgaattgggaagtccttcatcttgcagctctaccatttggaatacatggccttcaaggcctatcagggaaagagagagatgaaggaggcacgtcatgggttcttaactgttttgaccaggaagtgtcatgtgtcacttctcttcacagctcattggccagaaccagtcacatgactccattctaactgcaaaggagaatgggaaatggcggggaggacatgggatatctcataagcactttctgatggaaatggacttactcaagataccctttcgaggtagaagtgatctgacttgttgatagatcagatgtagggatttgggatagtagtgataaagaaatgggaagagtaagggataattcccagatttccctcattagcaattgggtgtagatttaacatatcccaaactaaactattgcccttcccttccaatgaatctgctctcttcctccatcttagttggtgaaaattccatgtttctggtttctcagttcaaaagccttagagtcttacctgaattgtatactttaagtgggtgaattatctcactaaagctgttactatatgtatatacatatacatgacacatatgtatatacatatatacacatatctagaatctgttcacttattttacctccactgctactaccctggttccagccaccaccatctctcacctggaccactgaaacacagcagccagagtgattctgttataatgtaaaacagaataggtcatcatctgcaaaatacacagcaaagactaaaaccacattctttgcaatggtctacaaaggcctacatactatgacctctctttcgtaacccttgaccccacctcctcctatcatctcctcttattcattctcatccacccacaccagccttcttgctgttcctccaatgtaccaagggttcttgtctcagggcccttgcacttgttgttcctgctctctgatttgctcactcatacatctccttctcaatactttgctcaaattttacctttatagtggggtttccttgactgtcctatttaaaattgcaatccaaccccaacctcaatgtgtttaatcccctttactctatcaacacttttagagtatttatcaccttctaatgtattgtataattaattatttgttatagctagcattattgttctgcctttcctcactaaaatgtaaatttcaagagaatgtatattattgttttgttcactgatgcattccaagcattcagtagacattcagttagtatttgttgattaaataaataaataaatatgtgaaatgtgtcatcacgtggaatggagaagtctctggaccatagtaggtgctcagtaaatatctattaatttaatatcagtacaatattgatccacggactggacttagaaatgtttcccactgcatggggatagggattaaatgagattatgcataaagtgcttgacccatagtagattctcagtaagggttaatttactatgactttgcctcaaaagttatattcttcattctattagtcaggattatccagagaaatagaaccaatagaaaccaagaaattgtgtggggtgtgtgtgtgtgtgtgtgtgcgcgtgtgcatgtgcacatgcatgcatgtgtgtcaagagaggaagagagagaaattataagatactgccttgtgtgactatggaagctgtgaagtcccaaggtctgcagtcagcaatctgggggccccagagagcccatgtgtagctccagtctaagcgcagggcctgagacgggagagttactggtgtaagttttagtttgaaagttggcagcctagagacccaagaagaacccgtgttttttgttttgggtttttttgttttgttttgttttgtttttttgagacagagtctcactctgtcactcaggctagagtacagtggtgtgatctcagctcactgcaacctccacctcctgagttcaagccattcttgtgcctcaggcacctgagtagctgggattacaggtgtgcaccaccacgcttggctaatttttgtatttttagtagagatggagtttcacagtgttggccaggctgctgttgaactcccaaccttaggtgatccacccgccttggcctcccaatgtgctgggattacaggcatgagccactcactgtgcctggtctaatgtttcaatttgagtccaaaaggtggaataaaaaaagatatcccagctcaaaacaggcagaaagagtttcttcttatctgtgggagagtcagcctttctgttctatttcagctttcaactgattggatgagggccacccacattaggaagggcaatctgctttactcaggctattgattcaagtgttaatctcatctaaaaacagcctcactgacacagccagaataatatttggccaaatatctgggcaccccatggcccagtcaagttgacacgtaaaattaatcatcacatccatcttagaatatgatttcttctccttccatatatccaaagtccaaccatccttcaaggcccagtaaagaaccacctcttcctacaagccttccaccacactccttttcactctgagttctataccatttttaaactttatttatagtcaacctcagattctctctgggtagatgtctgtgtgtaacttctttgccagtgcattcttctatgaactctcctggtgatgtttcattcactaatgctttttttttttggcatattctttcttccatacacactccacctagtccttctggcaatgtatacagtatgagagacaggcatgccttccaactgtctcatcacaaagttataagaaatagaagttaataaacaggaagcaacatataaaaacattgagtcaaagagatggcacacaaaagctgaaatttccattgctgccaatattccaatctgtagatgggtctttaacagtccccaaagtagggagcccatgagcccatgttctcaggcctttcttcctcctgacttcagttcggcattctctgatgtggtgcttcaactctcactcctccttggatcctctgtcacctccaatcttcccaacactccagtagccatgctgttatttctggaccatcctcagcagcatgcctaacttcccatgatacttggaaatctactttccatgcctcaaagaattaatggaagagaaagaattcataaagagacctggggtttgccttgcacaatgccatctttgcagctctgcaatcccacgtcttctcctcctgtgtgtgttcgtatggagcacttactggaaaatccatttgaggatcctctaagatctctgcccagtcagatacttctcctcccacacccttctggccatgatgctctttatatcaaagcatctacatgctgcaaagtgggatcatcctatggtgtatcttttctgttggacccaagcatacaccgggtttctccagctggccactaagtctgagggccagttcttagtccaatctttttttgtatctccctgacttttagtagtaggtgctcctctaatccctgctaatcactgagtgataccaatacagatcagaggattagctaattcagtggagggatgctttttgagagtagacattaggctgctagtagcttccaccagccaaaatagtttttattttaggtgacaggggtcacacgaagttgaggagcacttcaatgaggaaaacattttttgagtatctattaaatataaagtattgtactgtagcatttaccaagtgtttaccatgtgtaagacatcatctcatatgcttcatatatatccatacaccttaaacaatttaatcctgaaaacaactctggtgagggagcattataattatactcccttgacagatgaggaaactgaggcacacagatgttaagtacaacagcaaatgggctacaagagaccaggcagatacatgatactatcacgaagagcagagtaagacaaataccacaagaaaagaaagcagagagggtagttctctcacctgggatttccgtatgtgctttgcctacctggagaacttaacatgtccttcaagacccacctcaagatctgtgcattttagtaaagccttctctaaccccttcccccagcagagctgtctccaccctttgttggcccctcctgctgagacatagcattggcccaaccccaatcaccttgcatgatgactgcttccatatctgcctccctcgctgggccatgaactctcctggagggcagggacagattgtgcttcaaggccttctcagcaccaacccttgttgatgataaagcagtgaggcaggcttacctaaaggcctccatcctgaagtgacatgtgacttccactcacattccattgcccgcagcaagtggcatgcttctggttgcgttctacacctcacactttgcctggtgaaattcagctatgccaaaacaaaaccaaaaaaaacatggggatggggactgccagttggctgagtgacaaacaggtggcggatggccaagccaagtgggcatatcatactcacaactgggacgcctgcaaagaggcacttctggaaatgtaggaaagttgtgagtctggatggtgtgggctatggtggaagcctttgggacacagaaggagcccacgcaccttcttcataattcttctctttatgttaattatcagcctgaccttggacagggccctttcccaaaagggtcctctttctctccattggcaaaatattgggctacaagcttactgtcttgtggttgtaagattccatgctcttgacaaccatgccaggcacctgcctcatctatgtgccaaaaatgttatctaccccctagtttgggatcctgagaaattttagcaaaatttgccaaatactatagagaaatagatacttttcctttcccatttttaaaaatcatctttttttctacccacaacaattttctcctcctcgaatactgagttccacgagtgaataagctatgtcatctctaagtttccagaaatgtagattccatggatcgagggaaagaagggatgaaccatcttttccctttcgtcacaggaagctgcagcacatttccaaagtaagatgggcttctaattattaaaaataaactctggcccacagcctgatttgcacattaatgtagccagcagatgcagacttgcaaacatgctctctggctccatactgagacccagcttctctgcccatttttcatgctgagattctctaaggacaaccatttctgtttggagaaccatgaaatcagctaattgctctctcaaggaaggggatgctgccctagggcttaagggggcaatggttccctagattctgactaaggaacttaaggaagatgaaaggaaacttaagatatgtagatatgttgggaggccaaggtgggtggatcacaaggtcaggagatcaagaccatcctggctaacacagtgaaaccccgtctctactaaaaatacaaaaaattatctgggtatggtggcgggtgcctatagtcccagctacttggaaggctgaggcaggagaatggtgtgaacccgggggcagagcttgcagtgagccaagaccatgccactgcactccagcctgggggagagagtgagactccatctcaaaaaaaaaaaaaaaaaaaaaaaaaaaaaaatatatatatatatatatatatatatatatatacacacatatatatatatacacacacatatatatatatacacatatatatatgtagatatgtattaagacttttaatattaagtggcagaaacaccaactgatactggctaatgcagaggaagtggggtggggggttgttgttaatttgttttgttttgtgttgttcatgtacctgaaaagtctagaatgtgggagatgattactagtttcaggaatggctggatctatgtgctttggcaagctgattaggagtttgtctttctcttttctagctcactttcctcaatgtgcccttttactctcaggcaaactcttctcaagctgtaacaagatttcatccccataggtaaataaccccagtgaagagaaattctgtttcctactagttcccacaaaagtatcagaaatgacccttgtacaatttaaatcacatgctcagtcctcaaccaatcattgcagctttgggatagaatacattaactgatcagatcagagcacatggaagtagggttgaggtccaccccactcacatctcatgaactaagagtacaaaggggtagttccccaaagaaaaatcaactttaaaacctggactaaatatgtgcactgttctgaggactctgtatagtaaatactaacaggtagatagggaagtaagaccagaactcaaagttctattgaagttatgaattattttttcccctctgttattctaggaccagaagatgacatggccccctgacaccctgatgtggtcattaacataaatagagagctctaggagacactgtatagttctgggtcaagaagtaggaaagggaactcctactcttagataggaatgaactgaaaaacaccatcaacaaataagaccttactgacatttatggaataccctcatccaacaaaagcaacattcaatttttttcaagtgcatattaaatatccaccaagatagagcatgatcctggatcataaaacaagctttaaccaatttaaaataatggaaattatacaaagtatgttctcaaactataatggaattaaactggaaatcagtaagagaaaaacaagaggaaaatatctaaatgctaacatattaaacaacacacttctaaataattcataggtcaaaaaagaagccccaagaaatatgagaaaatatttgaactgaatgaaaataaaaatacagcctatcaaaatttgtgaagtgcttctaaaatagtgcttagatgaaaatttatagtattggttaaaaaagaaagaaaaacaaaactgaaaaaaagaaaaataaagatctcaaatcagccatctaggcttccaccacaagaaactagaaaaagaagagtaaaacaaaaccaaagtaaccaggagaaagaaagcagtaaaagtaatgcagaatcaatgaaattgaacctgaaaggctatggagaaagttaatcaagtcaaaggtgttttttcaataattggaaaaatcaaaatgtgtctagcaagactgacagagaaagaagagataagatacaaatgattaatatcaggaatgaaagagaagatatcactacaggtcctgtggccattaaaaataataaggtaatactacaaacataatacatataaattcaaaaacttagataaaattgaacaattcttggaaaaccacaaaaaacaaaactcatccaagatgaaatgaataacctaaatagtcctatacttattttaaaaattgaatctatcttttaaaacctttcaaaaaagtcatttccaggcctgatacctttactagaaattctacaaaatatttaaagaagaaaaaataataattctacacaatttctttcagaaaatagaagtgaaggaaacatatacccaactcatttcatgaagcctgtataccaaaaacatacaaaaatagcgacaaatagaaaactgcagactaatatccttcataaatacagaagcaaaatttctcagcaaaataatagcaaccaaattaaaaaaacacatacacaaccaagtggaatttatagcaggaatataaggctgatccaatatttaaaaatcaatcaatgtaatctactatattaaaattttaaaaggcaaaatacatcatcatacgtaatccagaaaatgcatttgacaaaatgcaacaattcatgataaaaaaaaaacctctccataaacttgaaatagaagaaaacatcctcaatctgacaaagaacaaatgtaaaaagcctacagctaacattctacttaatggcaaattatgaatgtttttcttatcagattgggagaaaggcatggatgaattctcactgctcctttttaatattgtacaggaagtcctagctatttgcaataagcagagaaaagaatcaaaaggcatacagactagaaaagaagaaataaaaccttctatttgtagatgacatagcgttctatacagaaaatcccaaggaatctataaaagcttctaaaactaatacctgagtttagcaagattgcaaggcaacacacaaaatcaatcatattgctatatattagcaatgtataattggaaaacaaaattttaaaacaatgtcattcacaatacccctccaaaaagtgaaatacatatataagacctgtatgctgaaaactataagaaatgcttatgaaagaggttaaagaagacctcaataaatggaaagatacaccatgttcatggattgcaaaactcagcatagttacaatgtcagttcttcccaaaatgatctacatatttaacacaattccaataaaaatcccaggaggatttttttttaaatattgacaagtggactttcgaatttatatggacatggaaaagaactagaatagccaaaacaattttgaaaaaggaattacaaagttggagcacttacactacctgattgtatgatttcctataaagcttcagtagtccagatagtgtggtgtcagcaaaagaacaggcacatagatagcataagggagtttcttggggtgatcaaatcgttctatattctgattctagcagtggctgcacaaacctatacctgagttaaaagtcatagaacagtacatccttccaaaagtcaatggtactatcttatacttttaaaataaaatttctttttagaccttttaattgaaaaataaacttccaaggcgttaagtcagttcactggcgaaaagaaaatgtttttaacagaagcgctgaaacaatccatatggaaatgaatgaacttcaactctatcttcattccatacacaaacataaattaagacagatcatagacctaagcataaaagtgaaaaccataaagcttctagaataaaacacaaaagaatacttttgcattcttagattagacaaagatttcttcagacattaaaatcacgaagcataatgaaaacaataggtaacttgaacttaaattttaaaatccctacttatgaaaagacgtcattaagaaaatgaatagtaaaaaacacaaatggggagaggtttttgccacatttatatctgacaaatgacttgtgtataacacataaagaattcctacaaatcaacaataaaatggcaagctaccttttttaaactgggcaaataacttaaaagatacttcacaggggaagatacacatatagctaataagaaatggtatttaacatcaatgcaaattttaactacagtgagacaccgttttatgctcaccagaatggctattctaacaatacaaaatgtgg

SEQ ID NO: 520 - DNA, 1927 bp, Homo sapiens
ctaggtttgtaacctatatttaaaagtagaacatttaaaacattttagtagtatatagcactgaaaagtggctttttagcgtagacagttgtttttcaagaaactattttgtaatcctagctacttgggagcctgaggtgggaggatcgcttgagctcagaatccagtctgggcaacaaaggagaattccagcctctttaaaaaaaaaaaaaaaaggaagaaactatttgggagttttgtgaacaatggatatgcaaaaagacaggccattgttatgagaggcctaattgtgagtaccttctagaattgtatataagcatgattctcttcaatagtaaaatctcagcctcttcattttagaaatctaatataggaaaaagaacacatttctccatagttgtaaaacataggttctcagggtgaatgcccatctttgagcaagtttgtcttcctaatggtataatactgtaagtctgttatctaattttggcttgttgtcacttatttttcataatcaaagaaaaatgatttaattttaaaaagatgctctcctttctgttttcttctcttggatgatagtatccctatctgtctgagtttatagaatcttaatttttacctgctcttaccacatacatctgattagtcattaagtcttactgattctgcttcagaaattttgttttatgcttcactctcatgctaccaacttatttggtagcttcagcagttgtctaagctggggttggcaaattttttctgtaaaggaccaaatagtaaacattttaggctttatagcccatataaagtttttttttaattttttttttttttaaaaaagaaagaaatgtaagaacccacacctgtaattgcagcactttgggaagccgaggcagggtggatcacgaggtcaggagttcaagatcagcctggccaacatggtgaaaacccgtctctactaaagataaattagctgggcgtggtggtgtgtgggtatgtgcctgtaatcccagctactcaggaggctggggcaggagaatcgcttgaacccgggaggcagaggttgcagtgaaccgggatcgcgccactgcactccagcctgagcgacagagtgagactctgtctcaaaaaaaaaaaaaaaaaaaaaaaagtaagaatcatacttagcctggaggccatacaaaaataggtcacaagcaggctgtgggaaggatattgtaagtgggccatactttgctgacctctggtctaggctattacaacaatttcctaattggagtatttgtcaccggtattttaccccggtgtaagattgcctccatcttacacattactgccagaatcatctctctgaaatgtgaccatttcacttccaggtaaaatctttatgtgctccttttagctaagttttcttgcttaaggtattcatgtattacttcggggattttttttttttttgccatttcttcataaccatctatattatttattcagtatttttatagacttttttttcttaaaggaaagtttatactgtgaatggaaaatcaatattgattgccataactagaaaaccaacaaaaggcaacagtaaaaggaaatatagaactatgaaatgcctgtttcatgtagcacccaatcatatatgtactacatttcaaaaagtcactggcttataaaaatattttttagcatctcatacaagtctcttcataatctgttatacagctcaccttacttgcacgattgctgagccaaagcagatcgaaagtcattttggtaagaggctagatgctgaccttgtattctgaaaatctgatgattctactgttgttgatgtgattccaagtaagcctgtgtgaacttctgggctattctcagggaagtgtttatgacacattgttgaaggtatcatcagggcagttga

SEQ ID NO: 521 - DNA, 3159 bp, Homo sapiens
tcccttgagtatatacccagtaatgtgattgctgggttacatggcattttttctaatactctgttgaacaggtgtagtgagagagggcatcctcatcttgtgccgatttagaaggggaatgcttccagcttttgcccattcaatgtgacattggctgtgggtttgtcatatatggctcttattattttgaggtatgctccttcagtacctagtttattaagggtttttaatatgaatgggtattgaattttatcaaatgccttttctgcatctattgagaaaatcacgtggtgtttgtctttagttcagtttatgtgatgaatcatttttattgatttgcatatgttgaaccaaccttgcatcccagggataaagcctacttaattgtggtggataaactttttgatgtgctgctggatttggtttgccagtattttgttgagaatttttgcattgatattcatcaaggatattgacctgaaattttctttttttgttgtatgtctgccaggttttggtatcagaatgatgctggtctcataaaatggattaaagagaagtctctcctcctcagttttttggaattgtttcagtaggaatggtaccagctcttgtttgtacatctgatataatcagttgtgaatatgtctggctctgggctttttttggttgataggctatttattactgcctcgatttcagagcctattaattgatctattcagggattcaatttctttctggttcataccagggagggtgtatgtgtccagtgatttatctattttttctagattttctagtttacctacataaaggtgttcataatattatctgatggttgtttgtctttctgggggtcagcggtaaaatcccccttgttgtttctagatgtgtttattttaatcttctcttctttcttcttgattggtttagctagtcttctatctatatgattaattttttcaaaaaccagttcctgaatttgttgatactctgaatggtttttcatgtctcaacccccttcagttcagctctgattttggttaatttcttatcttttgccaactttgggattgatttgcttttgattctctagttcttttagttgtgatgttacatttttaaatggatatttttctaactttttgatgtagacatttagtactataaatttccctcttagcactgctttggctgtgtctcagaaattttggtatgttgtatctttgttcttattagcttcaataaatgtttcctttctgctttaattttataacttacctgagagtcattcaggagcagattattgcattttcatgtaaaagtataattttgagtgaatttcttagtcttcagttctaattggattgcattgtttatatggtttggctatgttgtcacccaattctcatcttgaactgtagtccttgtaatccccacgtgtcatggagggactcaatgggagataattgaatcatgggggtgggcttttcctatactgttctcgtaatagtgaataaacctcatgacatctgatggttttataaagggcagttcccctgcacacaagctcttgcctgctgccatgtaagatgtgcctgtgctcctcctttgcattctgctatgattgtgaggcctctccagccatgtggaactgtgagtccattaaacctctttttctttatagccagtcttgggtacatcttttttttttttttttttttttttttttttttttttttttttttttgagacggagtcttgctctgtcacccaggctttagtgcagtggcatgatcttggctcaatataacctccacctcctgggttcaagcaattctcctgcctcagcctcctgagtagctgggattacaagcatgcaccaccacacctggcaaatttttttatttttagaagagatggggttttctcatgttggccaggctggtcttgaactcctgacctcaagtgatatgcccaccttggcctcccaaagtgctgggattacaagtgtaagccactgcgcctggcctggtatgtctttattagcagagtgagaatagactaatactgtaaattataactgtgagtggggcactgctgtaaagatacctgaaaatgtggaagcaactttggaactgggtaacaggcagaggttggaacagttttgaggactcagaagaagacaggaaaatgtgggaaagtttggaaattcctacagacttggctcagaatacaggaagatgtgggaaagtttggaacttccaagagacttgttgaatggctttgaccaaaatgctggtagtgatatggacaataaagtccaggctgaggtggtctcagatggagataaggaactagggaagtatgacaaaggagactattgttgtacaaagagactggcgacattttgctcctatcctagagatttgtggaattttgaatttgagagagatgatttaagatatctagtagaagaaatttctaagtggcaaagtgttcaagaggaagcagagcataaaagtttgaaaaatttgcagcctgacaatgcaatagaaatgaaagacccgttttctgaggagaaattcaagccagctgcagaaatttgcataagtaacgataagccaaatgctaatcaccaaaacaatggggaaagtgtctccagggcgtggcagagaccttcacagcagccccttccatcacaggcctggagatctaggaggggaaaatggtttcttgagccacgtctgggtgccccccaccctgtgctgtgtgaagcctagggatttggttccctgtgacagccaatctagctgtggctaaaaggggccaaggtatagtttgggccatggcttcagagggtgcaagccccaagccttggcaactttcatgtggtgttaggcctctggtgtacagaagtcaagaattgaggttcgggaacctctacctagatttcagaggatgtatggaaatgtctggatgttcaggcagaaatttgctgcaggggcagggcctgcatgaagaacctgtgctatggcagtatggaagggaagtgtggggttggagcaaccacacagaatccccactggggcactacctatgggagctgtcagaagaaggccactgtcctctagaccccagaatggtagatccact

SEQ ID NO: 522 - DNA, 100080 bp, Homo sapiens
gaatgaatgagtggctgaataggaagtgtgggctggtgtgtttagcctcaaagcctgtgatccactgactgaccctgccatagtccacttcctccaaggcctctcatgtcttgccagtgcagagctgcctctctcctctgaacacacagctgtcgtggtctgcaccagcactgggcagtgatgcatgggctgcttctcctccttgtacctgctttgatgatttgacagttgcattatttcacattccccatgataaagcccagtgcccagctgaatgataaatgttccttgaaggcatgtattgtgaagtagaagaaaaagtcctctgctgaggggcggagaacagctgctttaagagagtgacaagggttggagcagcgatgtggagcatgtctgaggctccagctctgagcacaggtgtgggaacctgagcgacacccaaggagtggggcatgattgcccagagggccatagacaaaggaggaagggtgctatgggaccaggttctggagcacagctgaacctgagaagcaagcagataatatccccaggcatggttgtgcagggatgagcagaggctgaaactcatatgagaggacgggctgggttcaagacatcagatcagtgtatctgagtttgtaccagtgtgtaagaagtttggccaaaggaggaggcctggagtgcaggggctttgctaagggttagaaagagcccaggggacccactgaaggaaaagctagaccacactgaacagagattaggatcccttgtaggtgtaagggagacaatctccttgcagacctgtgttccagttctagctcctctacttagtcagtcttaaactgggtaagtgtcttaacttttctgagctttggcttcctcctctgggaaattaaggtaatattgcctacctcatagggattaaatgggaggacaaaggtgaagcatgtagcactacccaagaatgtaatgtctgcagcagtggaaggctaagctgcatggggatgagcttcctgaagggcatgggtgaaccaagggtctttaccttgggcagggattctagctcatgggggagacagggtgtcttagtctgctcgggctgccatagcaaaataccatggactgggtgtcttcaacaacagaaatttattttctcacagttttggaggctggaagtcgaaggtcagggtgtcagtgtggttggttcctgatgagggctcatttcctggcttgcagacagctgtcttctgactatgtgcttacatggcctttccttgatgtgcacacgtggagagagagagaacacatgctctgatggctcttcttataaggacactaattctgtcaaaccagggtccagccttatgacctcgtttaacttaattacttccttagaggcctcatatccaaatacagccacattgggggctagggtttcaatggatgcatttagagttgacacaaacattcggttcataacaagtagggtaaagggtagcttaagtgacaagaagtcctctgagcactctgaacagagccccagtccagtctccccagtgtggcctggcttttcataccagatatgagaatggttgaattcagttttgctcacctggaattgtccttaaagtgatattccactgtgcatattggaaaactcagtcttcagagttcattgggaaatcaccatcaatactgctgcttttatcctgtctttgggaagtggagtagggtctctcagatacgagaaacctcatcagaaggaaagcacatgttctgctgccaccttcatgcctggtgacacatttccatctggagcagccacagaccataccactgagaccataccactgcactccagcctgggtgacagagtgagactctgtctcaaaacaacaacaacgttttccctgtggggaatgccatttcttctttttagagtcaaattgtgtcctattccatttccagataccgttttctaggacaagttccccagacaggaatctcgacattctttcagcagcatcgttccacagtgatttgccctttgtattctttttaacgcattcttcctgtgtatgtattgaatgaattccaaaacaaatgagtgagtgaatgaatgaatgaatgagttgttttcattgtgattgtggttccccaagagcagagtttattctttctttccacacacacaaagaaaccctactggccagtagatcgcccaataagtgttagcttcttacatgacaggctccccgtcagagagctattcactcagttcataaatttggaaatctcaggaatattttgattttcactgcattggcctttttacaccatgtttactcagtttcaaccttacttcaataaagcagaggcttgatcatactctgcacagcctactgcatgtctcggtgtgatgagtggatcttgagccacagcagggactgccaatctgtcattttctgaggaatactccttttttattggctctgatattttcatgtgtgatctcagcagctgtgcctttgtgtttgaaaagagccaggtctcactgaggagctgtgtagccagtagcatttattgagtttctgctttgtccctccacgtaagcagtaggaaccctgggataaattgtgcccatcagggaggagatgcctctatctctggggagcttaggaaggagctggggagacaggacatacacaagagaggttccatgaggagcactgagaaaccagaagatggtttcatgattcctgggggccagttaacctgccagggcttctctctccctgaggaggagtttgataagaaagactgggttcaattagcagctgattaggagacatgaacagagtaaagtgcactttccagacaactattgctgactgctcctgtgggcagggggctgaggaaattgctagaccaggggtgattttgcccccaagggaaaatttggcaatgtctagagacattgttggttctcacaactaaggtgggggaaatgctactggtatcgagtgggtagaggccagggaggctggtacacatcctgcaatgcacagcacagacccccaccacaaagaatcatctgtcccacaacatcagcagtgcccaggctgaaaaacctcatggcagcctgagtgagcgtcggggcgtggtctgagtgctgggaactgggtcacttttcctccttgggtctcagtttacttatctgtgacgtaatgatctcttaggttacattcagccctaacattctgtgatttggtgaagctaactttaactagagattaaaggtgggatgtgaatgtctttagaatatcgtgctttaaaaaaatcagaagaaatatggagggcatttaagagactttctaggaaatagcgcttaacctcaggtaaatacttaaaactttgaaccatttcaccctcttaaggagctgtacaaggagctgaaagggcctcgttctagtgctttgtctctaaggaaggaatttttgttggcgctcaagggacagcccagagcagaatcttctcctcgagttacacaggactaagatgccagccaagggcacctgagggccccttttcaagtcttgtccccactgccaagtccccgaaaggggaagcctttcccacgcctgcaccattattccacctcctctggctgaatttgagccacaccctcacctgatacctgtctctgttcatatcaaaaaaagcctgctcctctagaccttaagaaatgaccagagggagaatatgagaaaaaaaacaagctctacctgtgtggggaagccagcctaaagggagaacagattgtcagaattgccatgctattacatgtactgggactttccagaaaaagcaattgcttccaatagaatccccttgccacaaaatagtaaaggctgtttaatgaactattttaaaaatccaatgttaaaaattcaaatcatccttgtaaagcatgctgtttatgaagagaaaattccacaggaagataaccctgatgaaggatctatcaccaggtcgtacgtatgataattttaaatttcagaatgtttggcaatgttttcatggaagtgtcaggaatttcgttacagtcacaaatcatgtatgtgtaattagaatgctaaaacagcacattttttctatcaatgtaaactggggccccaaaggatgaaaaaaaatttgtagatgcccattactctcatattacaaagcaaggtaagtccaccgtcaaggacttactaaggggccagccggtagctgttttgcaaccctaagcccatttaccgacgtggaggattactctggatctttggaaaggttgtcaatgtgtcagcttctctgacccaccagggccatggcagagggaagaggtgcttccttctcaccaagtgacaagggagagatcaagaggaatactgagagagcttgatgctcatccgcaggttagaggagtgcaggaatggataagagcagagagagaggaagaaggctgcgttgagagccactgctgtaccccagctgttggggcaagaatgcagtttttcagtaggccaaccagacctctcctgagggtccagtgaggagcctgtcacagagcctcgcccaggtgggctgcatggaggagtgactgggccctgacaaaggggaagtctgtgtgaggtagacccctggatgatccggcactgaggttcagtgacaggcagaaaaatggcggccgcatcataggtgtttcaatgggggattcacagcagagccatctccaaggccccacacaagctttcctggagacaaatgccagcttcagacgtccgccaagtcctgagtgcacaacgtcctattatatctggtcctattatataacccaaagactatgactattttttcctaagtccccttcataggccaactctgggaggacctcacaggctacaggaggaggaagtagaatctagaagaaagagaaagaagcagccaagctttcccatatctgcccttcaggttcctaggacgaaagcacagaagctctaaatcataagaagctggagttgttattctaacactggaaggaacatttttaaagtgtacagaatacttgtaagagcgagggccaggcgcggtggctcacgcctgtaatcctaacaccttgggagtcttcagtgggtggattgcttgaaccctggagtttgagaccagcctgggcaacatggtgaaacgccttctctacaaaaaatacagaagttagtggggcatggtggcgcacacctgtagtcccagctactcaggaggctgaggtgggaggatcatctgagctcgagaggtagaggctgcagtgagctgagaccataccactgcactttagcctaggtaacaaagtgagactctgtctcaaaacaacaaaaaccccataaaaaaacaaaagcaaaaaactgatggctcctcagtcagtctattagccttgttcttccctggggttccctgagggatataaacccatgccccaaggcacccatttctgaattcactcctctcttttgcagttagaatggttctctgagcatccttggaagggatgaggggctggcacagtggctcatgcctataatcccagtgctttgggaggctgaggtgagaggatcacttgaggccaggagtttgagaccggcctttccctgaaaacaaaaaaaaaaaaaggaaggatgaggaaacagtcatccaaatcattttctgtcctgtcctgtgttcacataaagaatcttgttttacattaaaacattttaccttcagaagaagtttaattttatttctcaaactgtacattttatacccagaaaatccaaagtctttcataacctggcccctgcttaccactccccatactcccttcatttgtggataatcatttacatctccatggctttgcacaggccatttctttctttaaaaaaaaaaacaattaattttatcaaatagagatggggctgttgtccagactgttctcgaactcctgggctcaagcaactctcccacctcagcctcccaaaatgctataatcacaggcatgagtcaccgcaccggcctggagaggccgtttctaactagaatgctgttggcttcttgtacttcagtaaagaataaaatgaagactgagagaccaatgattgagagatgaggggaaaagtttcactgccaagcaggaaatctaatccaaaacagagtctagtttccctggtggatgagattcaagggagaggaaatggggtaggtctttaaaagccaaaacgtattgaactgtctctatcctattttaggagagcaaagtcttggcatgttctaattggtgactgatatctgggcttgttgattaggaaaccacagagctggctgaaggtgacctgctgtggtcgcatctggatcacggtgtgtacttgtctgtgatgtggctgtgaggcactagaatggggattatggtgtctgggaaattctcctgcctaatatcccctgtccactattccaccctacacgccagctcgactgagggaggccccttcctctgtgctgctgtaactctcaggctcatgcctccctgtgacggcactcaccctgtgtcttgtttaatcattgattaatccttgtgtgtccagcacccagaacaatgtctggaacactgtagccacctgcggtttatttaatgaatcagtaacaatagcatatgcaaattgaagatttatcatttctattgtttcctctaaagtatacacaacagacatttctttagaagtgacatttcaagattcaaaagaatgtagttttgaattgaagtggggtgtagagaatgatggtatgaggcaatatgaatatcttggtaggggttcaacttatcctaactagtgatttaaattaatatttatgtagatttgatttaaatcaaatccatcttggaagggagaaatgtttataacagatgggcatataatagaaccctgtaataaaatctaagtttaaagctcagcaaattcctttcggcttgcagatggagttgggaaaaacagttgacattggtgagttacagttagtttctcaggaaagctagtgattcaagaatgaagggtgtttttctgctagaaaggaagtactgtagagaagatgaattctgtatccaaagacatgtaagagaagatgtgggaatgacagcaggaaaaagaggctgtaccttaaacaatagccagatggaaacaaacagaatagcagatagtggtgggtatgacttgatttttagtgccattcattacagtaagtaacatttactgagcacctacattgtgcctggcactgtgctaagtgcattttatgatttatctctgtattcttcacaggacttaggggaggatgctaatattatcaccagtttacatatgaagaagttgaggcttaaagatttttttttaaagcagcccaaaatctcaaagcatataagttatggggcccgactccagaatctactgttaaccatcttttcatgacaagaaatagaaacaaaactcaaactaactcagaaaaaagatggatgtcattgggaggaatactagggcatctgacaagactcagagatgcatttggacattagggacagctgcaaccagggtctggaatgctattcttttctttttttattttgtattttttgagatggagtctcactctgttgcccaggctagaatgcagtggcacgatttcagctcactgcaacctctgcctcctggtttcacgcaattctcctgcctcagcaccccgggtagctggggttacaagtggccgccatcatgcccagccaatttttgtattttagtagagacagggttttaccatgttggccaggctggtctcgaactcctgaccccaagcgatccaccacctcagcttcccaaagtgctgggattacaggcgtgagccaccgcgcccagcctggaatgctattctttttctctgtctcttatttctccttctctatgccttttagctttattctcttcttctgaagcttagcttttttcacttggcaggaatacagatgattaaagctggtgacctcctatcttatggagtcaagcagcaggaaggattggttcttttcccttagttttagttcaaaaagtccaatgatgggcttagtttgagttggggcctcccttgttttccccaacccctcttttccagatcagtcatctatggctaaacagtctgagaaaaattattggcttagcttggattaatcatgagcaagatcatatagcacaaacacggccttgggggccatccctgtgtcccggacaatcctggagaaagagataacactttaaattgaacatccatccccgagtggatgcttaaaaatgcaataatgaggaacacaggttactttaaacgtaaaatatttaagtgagaaatgcatagctgtataactgagttgtatggggattccccagaaatcagacagtctgtgctttcagaaaatgtacccagattttttgttcttaggcacaattctggagaggcattctaagctattgtttggtacttcttatttattttttaaacagtagatttccttcatgatgatatagttctgaaaataagtgagcctgatgacaaggttgaaaggatttttgttttcataagcttcttcatttcagtaatttcagagactgggagtcacacagtctgcaatgtttaacaagccttcctatagtatatagaagctccttttcataaacatccctaaagtcatcgtgccgcaagttaagcctgttttctttgagtttgttctcagaagaaatgggtatgagcatagaagcttcccttcatcaaaccacgtagttgcatcctcagttcctagcatgtcccctctgggtttattgtccagtcagcccttttattatctcagttactctctgtgaatctcctctgccatctccacgtacccctttttgttgccaagcccagatctaattggtcagtcttttagtgaaaccccagagcaacaaagacaattcctcaccccacacccttccccaggcatcccgcaccacagtgattgtttaagcacagggccacaggccaacttgttgcatttgaattccactataaccagcattgtatctgtattctaaaaagtgtcaagtctctacattacaatcaaagcatcaatctctaaacagtgggggagaaaatgtacctcaaggttaagagaatctaggctgggagtggtggctcacacctctaatcccaacactttgggaggccaaggcaggtggatcacttgacctcaggagtttgagaccagcctgggaaacatggcaaaaccccatctctacaaaaaatacaaaaattagctgggcatagtggtgggcgccagtagtcccagttactcaggagactgaggtgggaggaccacctgagcctggaaggtcaagtttacggtgagccatgatcatgccattgcatcccagccagagtgacagagaccctatctcaaaaaaaaaaaaaaaaaaagaaagttaaaagagtctaacagcaagtagaacaaatggaattaatgatgacagttcgatatattgtgcccatcacagtcagcagatccaaaacagccactaagcactagatccaggagtccccgggcctttgcacccactgttccaaacactaccaaggatgctgttttcccagacagcccatggcacacttgatgggcccatccagatcttctcacagaaagtgtttctcagtgaggctttccttgaccatcctatttaaaactgtgactttctggttcagaccagcccacccaagtccaccatcagttgttcccaatcctcttttaaagctgttttatttttcctggcagcacttactggacatggtctatagttttagttgtctatctgtaattgtctgtctaccctagtagaatgtaacttctgtatgttttgttcactgctttattcctcatctcttaggagcatgcctgcctaccacagagggacccttagtgaataatcttttttttttttttttttttttgaggcagagtctcactctgtcgcccaggctggaatgaagtgtcgcgatctcagctccctgcaagctctgcctcccaggttcatgacattctcctgcctcagcctcctgagtagctgggactacaggtgcctgccaccacgccaggctaattttttgtatttttagtagagacagggtttcactgtgttagttaggatggtctcgatctcctgacctcgtgatccgcccgccttgtcctcccaaagtgctgggattacaggcatgagccaccgcgcctggcccatgaataatctttaagtgaagaaatctatgaatgcaagtagaattctttgtggtgaggaagagcacttgaacatttttatttatttattttatggagaatgtatataatgcttgctatatgctaaacactgttctaaatgattgacaactatatctcatttaatcctcacaacaatcatgtggggtaggactattatcttccccattttgtggataaggaaacataggcgcagtcatgaatcacagtgggcgtgtggcctattctgagtctgctctcaaacactaccatgctgcctttattaattaaataactgaaatatagcagaaacacaaaattggacagatttgggctggggcgagccacggagagctttctgggcaaggtgaattgagcacagatgctgcagaggaggcagtgaatcaaatccaagtgtgggagagacgaactgggagactcagaagtggcaaaagaaatggagagaaggatgtgcaggtgagaacagggatgcggggcccccaggatatacagagagaagcacaggcactaggagagactgactgagaagcctggacaaactgaatgaggcgtccactgatggcccccagggacccttcactacggcctggaattcaggagccagcatccagccagtggcttacgcaaaacaagggttggggaagcaagtgtgggcatgagcctaagtatatgtaatttaagagtgagatggggaaagagtgaagaaggaaagagagaggaaacacagattctcagaaatttgcattcataatctctcatctctcccctaatcttagattatcaaatatattcatcgattaaaacttctttaagaagtgagtggataaaccaattgtggtatgtgcatataaagaaacactgcttagaaataaagagaatgaacaacattttggtttctttcattccacttaatcaaaatgaaatcattttcattccacttaatcattttggttgatgcaacaacatggatcaacctcaaaatgattaagtggaatgaaagaaaccaaacaaaaagtataatctgtatgattccctttacataaaattttaggcaatgcaaaccaattgatagtgacagaaaacgggtcagtggatgcttggggatggagctgggggatgcaggaaggactggaagggagggattacaaaggggtccaaggaagtttttggggtgataagtatattcctatcttcattgtggtgatggtttcacaggtgttcactagtgtcaaaatgcatccaaatttacactgttttcccaaggtttttaagttgggaactctcatcttctcctaagatttgataaataatttcttgtcttctaggttttcttcttaagttggagatgaggggtggtggttaaaaactcctgcttagcttattttccctttagggattgattacacttatttctgtctcccttgcctgtgtgagaaaacctctccagccctggagcaacttcttggggcttctaagtggattgaattctggtccccagaagatatgtctacgtagaaccacaaaatgtgaccttatttagaataaaggtctttgccagaccttatttagcataagagtctttgccattgtaattaaggtaaggatgtcaagataaaaatcatcctggattagggtgggccttaaatccaatggtgattgtcctcatgagagatagaaaaggacagagacaccatagagggaaggccatgtgaagacagagacagagacgggagttcctgcaagccaaggaacactaagaattgctggcagctaggcacggtggctgaggcctgtaatcccagcactttgggaggctgaggcaggtggattacttgagcccaggagagcagcctgggaaaactggcaaaaccccatctctacaaaaaatacaaacattagctgggtgtggtggcatgtgcctgtggtggtcccagctactcaggaggctgatgtgggaggatcatctgagcataggaggttgaggttgcagtgagctgagatcgcaccactacgctccagcctgggagaaaaagtgagacccagtctcaaaagaaaaaaagaaaaagaaagaattgctggcagccaccaaagctaggagagaggcggattctccttcagagcctccagcaggagccctacatttgtgttgttttaagctcatagtaatatgttatggcagctcaggaaatcaggccactaggtacttttgttgctactgtccttagttctaccactgtattttgtttccgctgtttgttcttcattctctgaactaatcctgttagaattttattctcttagtatttcaccatttctacctagctgaacatgttcattaacttcttttttttattattttttgagatggattcttgctttgtcgcccaggctggagtgcagtggggcaatttcagctcactgcaacctccgcctccaagattcaagcaattctgatgcctgtctcccaagtagcagggattactggcgtgcaccattatgcctggctaatttttgtgcttttagtaaagacgggggtttgccatgtaggccaggctagtcttgaacacctggcctcaagtgatacacctgtctcagcctcttaaaatgctgggattacaggcgtgagccactgtgcctggccagaaaagggaaactttgagaagttaatgaacattggccgggcagggtggctcacacctgtaatcccagcacgtcgggaggctgagcagaaggatggcttgagcccaggagtttgagaccagcttgggcaacatggcaagaccccattcctaccacccccccccacacacacacacacacaaactgggtgcagtggtgcatgcctgtagttccaggtactcaggaagttgaggcgggaggattgcttgagcccaggaggtcaaggctgcagtgagctatgatcacaccactgtactccagcctgtgggacagggcaagaccctgtctcttaaaaaatcataaaaataaaaaagtaaacaaagtttccatttccttgtctgcagaatgagcgtgagttcctatgcctggggttggttgtgaggattcaatgaatccatacatggaaatgctttagaacagtacccagcacgtaacaaatgctgtattcatgtcattaccgttattactaggtactgctcacactttccaaggggtggctctctggtagcttcttcaaaattaatggtacattttcttccatcagggttattgatgaaatgttgcattagtcttggatcttgggtgatggtgtgagaaagtctttgcatgggtcctgggattaattctgaactaggttttcagcaaatccccttatgatctctcccaacaaacggaaaacctcagtggtgttaaaactagtcatggtttacctcaatggttggagatgagcaaagggctcccaggccattgcttggtccaccatcgaagccaatttactgttctttgttccacagcttcagcctaactttaggcatccttttccatgtgtgggccattggtcatatgcagaccgagcaaaaaaatgtaggaggcttatagaaaacccattggcatgtttggaaagacagaagtccacactgtgttgatgtgtggttagcagcatcttcttcactgtctgactacatatgaaactgactttaggccttgccaccactttctttctcaaagaaatatgaagaaattatgtagaataataaatatggagcttccaggtagtaagtttaatggaatgagtttagaacttttcacctccttaatgggttgtgagttaacctaagagtattttttatccataatttgcaatgcactgaggaacaggtaagcaaaacaaaatcaaaagcttcatcaaagccaagaaagattgcagctttcattccttctatttgcaaagcccttcaatgtcactgaaggctaagtgtctagctcccctctttatcaagccatgctgcctgtgcatctgctatggactcgatgtttgtgtcctcccttaatccatcactgaaatcccagcccccaaggtgatggtcttaggaggtggggcgtttgggaggtgattagctcatgagtgcagaatcctcatgaatgggattagtgctcttataaaagagaccaagtggctcatgcctgtaaccccagcactatgggaggccgaggcgggtggattacctgaggtcaggagttcgagaccagcctggccaatatggagaaaccccatctctcctaaaaatacaaaaagttagccaggtgtggtgacgggcgcctgtaatcccagctactcaggaggctgaggcaggagaattgcttgaacccagaaggcagaggttctagtgagccaagattgcaccactgtactccagcctgggcaacaagagcgaaactccgtctcaaaaaaaattaataaataaatgagagacccgagagctcttttgccccttctaccttgtgagggcggcaaaaagacagctgcctcttaatgagaaaacaggccctcaccaatgtggaatctgccagcactttaatcttggacttccagcctccagaactgtaagacataaattccggttgcttataagccacccagcttatggcattttgttataacagcccaaatagactaagacaatattctttttattattttaaaaaagaaattaaaggattctaaaacacataatttaagcttagagatttgtgatttccagaatcatctgagacttaggaggtctgagcatttgatatggtttggctgtgaccccacccaaatctcaacttgaattgtatctcccagaattcccgcatgttgtgggagggacccacagggaggtaattgaatcatggaggttggtctttactgtgctattctcatgatagtgaataagtctcatgagatctcatgggtttatcaggcgtttctgcttttgcttccccctcattctctcttgctgccaccatgtaagatatgcccttcaccctccaccatgattacgagacctccccagccatgtggaactgtaagtcaaattaaatttccttttcttcccagtctcgggtatgtctttatcagcagcgtaaaaacggactagtacaccattcatctatgtattatccaaagggcctctgttgtgacttcacccagttccattcaccatatttatatggtctcttgacatgagaatatagttttatgtgtatatcatttttttaaaaatcagaaagcaatttaatgttttcccctggtaaagtgttttgtatgttggcaaatcagggacttgataatgagtgcagtactggatattgagctaagtcagttaattgggctttggctctttagaagggtttggtgaagctctgcttatgggtaattgaggcttcaggttgccaagagttgggtgactaagaggtagctgttttggatcaagggtaaaattttaattagatgatgagcattctcaaagggcatgtagcaattttctgaactgcataatctaatggttcgaaatttagaaagtagtgatgtcatctctccatcttttcaaagaacacacatctgcctctgtaatcattttgtttattatttttaataacagcaataggccaatgctaagtaatatgatgatcaggaaagaaataggccccggggatatgtgaaacagctttgtcagacagtttcagctctacagaattgtgttttcttgatgaaatttctggcaaagtcttctttccatgttttcaaagtctcctcttcctcctcgttgtcagttcatttcctgtttcaaccttccaaggggtttacctatgttaaaatgaactgagttcaaatatagtccttcccagataaaaacttgtgactttctcttttcttgattgattttaatgaaatatatgctgaaagaagtaggaaactcactgagaatgtcaaacataatctgcaggtcattatatacccagagtttacagagggtaggaatgatatctattagtactataacgaatctgtttgcttgcagagtggctttctgacttgctgccagcctgtgcctattccacacttacactttttgacatttaaaatgcttcttaataaatcttagtcagttattattattattattttcatttgcattggaaaacagcattcttccttaccttccatagaaagggtgcaagcaggtctactggcacccacctgcctcacagtgcctggagcttaatagatgctgagtgatgcacaaatataatggatgaattcatttaataaatcctctttttatttatttattgtttatttttatcatattttttaagacacagggtcttgctctgttgcccaggctgaagtgtagtggtaccatcataggtcattgaagcctaaaattcctgttctcaagtgatcctcccgcctcagcctctggagtagctgggactacaggcaggcaccaccatggccagctaatttttttttttttttttttgagatggagtctcactctgtcgcccaggctggagtgcagtggtatgatcttggctcactgtaatctccgcctcctgggttcaagcgattctcctgcctcagcctcctgagtagctgggattacaggcaccgccaccacgcccacctactttttgaatttttagtaaagacagggtttctccatgttggccaggttggtctcgaactccttacctcaagtgatcggcctcccaaagtgctgggattacaggcgtgagccactgtgctcagccggccagctaatttttaaaattgttttagaaaagggagtctccctgtgttgcccataatcatacaatatgcaaccttttgtgtctggcttctttcacttagcataatgttttagggattcatctttgttgtagaacttcatttctttttatggctgaaaaatattccactgtatataaccacaatgtgtttatccattcatcttttgatggacatttgggctgtttccatcctttagctattgtgaatagtgctgctatgaatatgggatgtacacgtatttgtttgagcccccgttttcaattgttttgggtatctatccagaagtagaattgcttgctcatatggtaattctatgtttagctttttgaagaactgtagagctgtttcccacagcagctgaaccattttacattccaccagcaatgtaccagggttcttgtttctccacatcctcctcaacacttgttttcttcctttttagtaagaaaaaaaaatatatatatatatatatatatatatggctatcctagtaggtgtaaagtggcacctcattgtggttttttttctttttttttttccttattattgttattattttttaatagagaccgggtctcaccatgttccccaggctaatctctaactcctgggctcaagtgatcctcctgccttagcctcccaaattcctgggattacaggtatgagccaccacgcctggtctcatttggttttttgggttttttttcttctgagacatagtcttgctccgttgcccaggctggagtgcagtggcatgatgtcagctcactgcaacctccacctcctgggttcaagcaattctccttcctcaacctaccgagtagctgggattacaggcatgcaccaccacgcctggctaatttttgtatttttagtagagacagaattttgccatgttggccagactggtctcgaacttttgacctcagatgatccacccaactcggcctcccaaagtgctgggattacaggcgtgagccaccgtgcccagcctcattgtgtttttgatttgcacttccctaatgactaatgttgagcatcttttcatgtgtttgttggacatttatgtattattcttagagaaatatctatttaagacctttgcccatctttaggttgggttgtttgtctttttattgttgaattgcaggagttttaaaaatatatcctggatactagaaccttatcagatatattatttgcaaatattttctcccattctataggttgtcttttcactttcttgataatgtcttttgaagcacaaaaggttttaattttggttatgtgctgtggtttctgagcactagggaggcccaagcaggaagatagcttgaggatgggaggtaaaagctgcagtgagctatgaagctatgatctggccactgcactccagcctgggtgacagagtaggactttgtctctaaagaaagaaaaaaagaaagaaaaaatttaaaattttaacgaagtccaatttatcgatttttttcttttggctgctcatggtgtcctgaagctttttaaaatgacaggatcctaacacttgtgaaggctatgtcacgggcgtgtcctcaaccttggaaaaataaactttctaggttaattgagagctgtctcagattttctgggttcacacaccttagaagaaaactagattatttcaggaaggtaacctgtaccttaaagtcaaaattgtgaaagtatggatgtaacagctcttttgaaataattagaaggatacaagggccagaaggagcctcatacatcatttagaaaaggttctggaggaattttactttaatacaaattaaacaccagtggcagaatcataaacattttcaaactaatatagattagaaaggatggcatttggggattattatttttataatcagaagggcttgagaaaaagtttgcggaaaataaatacgtttcaacatttttctctgataattcattttgacaactactgtgttcattttgataactactatatcactttataaatgatgaaactatttcaaatgtaatgactgtacttttcacagtttgtatgcctataatttatgcaatgccacacaatcaaccaaacaactcttaactttatttttacttcagtgtattatttagaaatgatataaggaggccagccgcgttggctcgtgcctgtaatcccagcactttgggaggccaaggcgggcagatcacgaggtcaggagatccagccatcctggctgaaacccaactctactaaaaaataaataaataaataaataaaattagccgggcatggcggcatgcgcctgtagtcccagctactcgggagtctgaggcaggagaatggcctgaacccgagaggcggagcttgcagtgagccgagatcacgccactgcactccagcctgggtgacagagcgagactctgtctcaaaaaaaaaaaaaaaaagaaatcatataaggaaaaaaagccctacagtttactttctggttcttggttattatcaaagggcattggaaggttaagctgctgtaatagctttaaaaggggaatttaaggccgggcgcggtggctcacacctgtaatcccagcactttgggaggccgaggtgggcagatcacgaggtcaagagactgagaccagcctggccaacatgatgaaaccctgtctctactaaaaatacaaaaattagctggtcgtggtggtgcgcatctgtagtcccagctactcaggagcctgaggcacaagaatcacttgaacctgggaggtggaggttgcagtgagccaagattgtgccactgcactcaagcctggtgacagagcgagactccatctcaaaaaaaaaaaaaaaaaaaaaaaagtggaatttagttaagtttgggagacagaaagaagccacggctctcctgccttcttccaaatatactgaacttctgatatgtttgatcaaatgaaatgctcatggtctggcatgattataggtgcaagcctgtaatcccagctactagggaggctgaggcaggaggatgacctgagcccaggagtttgaggctacagtgcacaatgattgtgcctgtgaatagccactgcactccaccttgggtgatatagtgagacccacatctctacacacacacacacacacacacacacacacacacacacgaagaagaacataaacacatcaaatgtgagccattttgctgacttgggcatacaataaatccatatctctgggttctaaagatgtaccaatcttgcagtgagctgagatcacactactgcactccagcctggtcaacacagcaagactctgtctcaaaaaaaaaaaaaaaaatagtagaccaggcgcagtggcacactcctgtaatcccagcactttgggaggccaaggcgggcggatcacttgaagccaggagttcaagacccacctggccaacatggcgaaaccccgtctctactaaaaatacaaaaattcaccaggtgtggtggtgcattcctgtaattccagctactcaggaggctgaggcaggagaatcacttgaacccaggaggctacggttgcagtgagccaagattgtgccactgcactccggcctgggcaacagagcgagactccatctcaataaataaataaataaataaataaataaaataaagatgtgccaatcaaacaagtgtttgctctgtagatgaggtgagtgctcctgatcagatagtatattcaataaaataagcatgtcatcaaactaactttcttggcctttgttctttggttgaaaaactcccgttgacctcatgaataccacatttattaaccccggaagacaacagatagctaatgcaacataaatatctgtggctttaaaaatacatattattatgtgtgcagtctacaaacactttcctgaaattggtcttctgtgggcagtgatttaaacttttcaacttggacgcttttcctactgggggctgtaaagatgataactcagcccttactcttcagtgtttctcattcccgtctcccctacttcggaatgaaacacaatatcttaagcaaacagagcccaaagaggctgatcattggctctcattgtcccctgatactgtagccccgcccctttggcttgtgctgactagctgtttatattttagtaagggccaccctttaactcggcagcttgatgactataatgggcccagttgtctgcgggctgcggggagctaagtccccagattggaggaggctggctctggtcttcgatgcacaggagtggccgttatggaacgcaggtaaggacgcttctcaatgtgggataattctttttctgggccagctggttaatccggggctgggagaaacaagttgtgattgggttgctactttttcctggttttaattttttccctgcagaagagggaaggaaaagactgggatttgctgacaaagctcacagtgagctctgttaatccaggcaggaagggagtaaggaagcaaaaaatcgagggagagacacagctggatttgacaccaaagcaacatgaatgtggcaaagcataaggccagttccagtgatgttgtgagactcaaatgctgttttatttcctaacataggtagtcacagtcaggagcttagctgggcctctccggggtttctgtaagccagctgctagccgatgtaactcagtcgaccccatttgaaaggacctaatatctgctagtattttcaaagggcaaactgtagtagtcttgcatgttataaataggtctattcagaaatgtgggaacagtttagagcagacaggagactgtaaagttttactgccccataaaagtgctcaaagggtactatgtccctctgccgtgcgactgtggaatgaagaaatagccccaggtgaatagagcgtttgtccttgactacccaagtgagaagtcagcagagcctggggacgccatgtgagtcgggggtgaagcctgatgtgggctcagccagccacacctcggggtgcttgctggtttccggggtgtgaatgggtgagggtggaaaaccactcaggcaccggtctttggtgcctgctttatctcttggctggcccattcggtgctcagtgaggcacctgtcgtagctcacggggtgcgcaaagggcaaggaaagggttgtgctgtcattgcgacctgtaaggtggggagggggctacaacatctcgagtcctgggagttgctttagaaagtcctcctcctcctgctgaaaaaaagaatcacctacggcagctttgatcagataagtttctggtgagccccgtggtgtggagtcagtgaacttgcggtttgtgtttgttatcgacaggagcctgataaaatgaaaaggtgaggtttaatttttacataaagctagaggtgaaccatgggactttaatacatttaatgctttgaaagtctccccacctctccaaattccctcaacttgtatctattatctaggtacaccttgtttaaagccaccatgctgtttgcggatcctggaggtattaagtcagaatacaaagggtgtttttcaaatgaatttgacgccaagcaacatgaatgcttgaacccattgtatgaaaacaggcagtctctaagtgaggccaggttctcctggtgcggtcctagagccctggagagggatgagtcaccccacgaggaggtcctgacaaggaatggaaattctgactctgccagtgaacttttgactctcccaggtggggtggaggctccaaagggaaaggacaggtgtgcatcattcaccctccaggcccaccgcaggcctcacaaatcccatttggtcaggtcaatgcattctcaccttcccacctaagtaggtgtcccacagtttaactcaattctgacactaactgcagtgagtgcagaccctgaggtttaagggctcagtcctaccaggctgccccgacctcagaggccagttgcaggctgaaggttgtcacttgtgcttctgactagctggctatccatgagaagttctcacgatccttcctcaggtagattacaagctgtgtaactttgtctaactttgtgctgtaagtcagagattgacttcttggggtcactgttttgttagcatagctcacggaactcagggagacacttaattccatttaccagtttattataaagggtattacaaaggatacagttgaatgaatacatacagccaggtgaagagatggctagggagggtcttggagctttcatgtcctctccgggcgccactctcccagcgtctccatgtgttcagctatccagaagccctccagacccgctcctttgggtttttatggaggcctcattacaaaggcatgattgatcaaaccattggccatcggtgattgagtcaacctcctgcccctctttgctccctggaaacagggtcagggggtgtgtatgggtggagtagggagaaaggggctgaaagttccaactctctaatcacttgcttggttcccctggcaaccagccccctccagaggcaatctgggagccctcagtcgtcaatcatctcattagcatacaaaaaggctctttatcactttgtacattccaaggggttttctttctttcttttttaaatttgagacagggtcttgctccgtcacccaggctggagtgcagtggcatgatcatggctcactgcagccttgaccccttgggctcaagcgatcctccagatcctcccgcctcagcctaccaaagtgctgggattacaggtgcatgcccccatgcccagccaattgcaaggattttaagaactatgtgccaggaagcagagacaagaccaaatatatatttcttattataaatcacaatatcacaccttcctcatgattcacacttcaggtcacttactcactgtgtaactctgtgcaagttccctaacctctctgtgccccagttcccttatctgtaaaattcgctaaattccaggaagggccagccacactggtaggcctatgcggtgcggtggccgatgggggacagacgacacacagaggcagaagccaaagaacacgggtttaaaaacaaggggttaagagcaagagctttgattcagacgaacctggagtccagcctcactttcgttgttttacttatatgttattgggcaagttaccaaatctccctaagtctgtattccttcagccaaataatgggatgacaatctgtttcactggatgattgtgaggtttaaatgtggtcatgcatcaaagttccttatacagcactcagtgcacagcaaatattcagtgaatattaattattttattatgactgctaccagcatctaacgacagtcctaaataccatctaagtttaccaaatgtctctctgatttactggtgacattggataaaggaaatgctaagagaatgcagtgcagtggaaagaagggcgggctggacatcagcgttctggtctccatccgggactggccagcaggtggctctggaaaagggagtccctcagggtcacggttttctatctgtcctgaggcatgatcttcaaagtccattctagcttctgtctatgactttagatctgacagaaatctccccggaggaactcatgagccgtaagttaaacatggtttgaaatcacccttgagctccttgctgatcatgcttatccatgttgaaggctcatccaggaataatagatgggtcttgtgtgtggtttgaaaagttcacttctggccaggtgcagtggtgaaccctgtaatgccagcactttgggaggccaaggtggaaggatcgcttgaggccaaaagttcaagaccagcctgggcaacatagttagactttgtctctaaaaaataaaaataaaaattagctgggcatggtggtacacacctgtggtctcagctactcaggaggctgaggcggtaggatcacttgagcctgggaggtggaagctgcagtgagctatgattgtgccagtccactccagcctgggcaagaccttgtctcaaaaggaaagtacactttttattttcacaggaggtaatgatacattcaagttggttactttacacaagaagaaatttgtgtaatttcttacacaaagaaattacacaattttagataaatttatctttatctaaaattataataaataattttattatttaataaacaataaataaatctaaaactcatttatgtaaaatttgtcactatctaaaattttcatagtaaattgtatggaaaatataatatcccgtagatgtgtcaagaccagaacataggtcaaacagagctgaactcgagtctcaggtctgctggttgactgctagtgaccttgggcaagtcacttaccctctccagttcttgttttcctcacctgaaaatgggaacgatattgtctgccttatcgggctatgatgagaatggaaagctagaacatgtagactgccctccatagtgcttggcatggggtcgttccttttccctcccagatggaacactgcatccatcccgatggaggtttctagatgatgctccagaggattccaagcagagaacatttacaatttccatacattacaaaagtgtgagcctgcaaggcaaggtctggagctgggagcacatctggagcagtgggtgggtactgagaaccatatccacacacacaaagaaatgtgttcgttcagaagatccagcatcaattccttcttcctaagatttgacaagactggagtcatttcttcaccaggcccattttatgaaaaaccctgggaaaactgaggtccagcagccaaagatctaacacagcggaatcaggaaaaatggtggacaggcccctgaaggcacgtaaggagcagggagcctggtgaccttggtgcacccaatgcctccctaactagagtaatggaacaccaatgtggtttacattcataatcccttgcatttgagaatttttaaatctacttaaattttcaaacaagggacactcacaccacctcccacacttattagcatgctgttttatcactccgatatgttcaagggacccacccccataaaagatggaagatgaatcagaaaactcaactggaattgcactccctagaggggccctgggagttgtttagatatgcatagtctcacctcaaggcacatgctgggtacaagatcccttatcacacctccagtcctgctcagctttttaagggagcatttcctgatatataggtctttaactaccaggtgtatttgcccactgtccacctgtgccttcaagtaccgtacttaacaagttggaaccgagggaatggtacacttcacattttgcaactgttatgcaaatagaacttcaatgaaattcctcaaactgttgactctagaaaccgtgggagacaaagggtcagtgtctgacttcacgaacgttaccaacttgaaaaatgagatctattccttagtgtgtgggaggaagacatttaaatctgtagtaccctcaaagcctcactctaaacctggtctggcacttttcaatgtgtgttctttgatatggtaagtagttaagtatatcccaccagagaccttccaaggatgggttttttcctccatatgacttctctcactctttgcaggagaataaaatagagtttcaactgaactttaaagctgtaacctgatctcagaatcatgcaccataaacagcatttgtgcttttcaagatactttcaaatccatatagttttccaagatattcctagttgccacattgggtgatttaattttttttttttttttttttttttgagatggagtctcactctgttgcccaggctggagagcagtggcgagatctcggctcactgcaactttcacctcccaggttcaagcgattcttctgcctcagcctcccaagtagctgggattacagacacctgctaccacgcatggctaatttttgtatttttaggagagacagggttttgccacattggccaggccggtctcaaactcctgacctcaggtgatctgcctgccttgacctcccaaagtaatgggatttcgggtgtgatccaccgtgcctgggctgggtgacttaattttaaatgtagggacatcaagcaaaatgttgctgaggagtctctttcgcagcaaaagtcctgtgaaatctgcaaggccatctttttcatgggtccccaaatgtttcacaggcaactgggcaataattgcatttccaggaatgccaaatggagccaaatccttttaatagctcactgacatgcaggttattccactggggaccaaaaggaaggaactagagctctcaaaatatttgattcttgatttgtgctcttcactggatgattctattttcttgagagcatttttaacgaaacagcagcaatcagtgatttcttagaaatgtggcccctttaaatacacttcagtgaggctagctcttgtgtttcctggacactctgtgtgttctggacatactggaggcacagcataaatattaatgctggccattacaaaaagaaaatgaaaagaccccataaggcagcagtgaccctagaagccccagaagccgtgttggaactgtgacaaggaaggatagtgacaagatctgaaaaaagcagccctcttcccacactcaacacatgcagtaaacccagacatgcagggcaccattgtctgagctgtcactggagggctgggaggagacaggggatggggcaatggcagcctacccacccctcctcatcactgtccaggggcattcaggaaacacaggcttccaatatgaggctgcctttttttctcacaagccatgctcactaggaatccatagcggccatctgcacaccgacctggtggtgtctcaagcttccaggtgtggttttgggggcagggtccttgaggaagggggtgctgctgacagtgaggtaacctgaggtcagctctggacagggctgggtggaagaagagtgtagtgactgctgatccctgtcctttctaggaattggggttactgggtcagagaaacatctcaataccttccaggcttccaaggctggttgtaaacctgctccttgataaaagaaactacatccaacctttaggagcaaggtggggtaacatgggagcagatcttagttcatttgtttgtttgtttttgcttgcctgcttgcttttttgttttttctttttctttttttttttttttttgagacagggttgcacactgttgcccaggttggagtgcagtggtgcaatcatggctcactgcagccttcacctcccagacaggtgattctcccaccttagcctcccaagtacctgggactacaggcatgcaccaccatgcctggctaattattttttatttttttgtagatatgggattttaccatgttgcctgggctagtctctgaactcctgggcccaaatactctgcccacctgggcctcccaaagtgcgggattacaggcatgaaccacctcacccagcctacaaattcttatatgacaatttgaatctctgcttggatttgttttatcctctcttgtgcttgtaactcaaactttaatacttgaaaagtttcatcaaaatttaaatatacttttctaaatctgtgagaaggctgtctcccaagatggtttgttactgcacatcttttccccggtagatggaaatatcccttctctattctctttcccttagtctttcaaaaactcagtgaggaggaagtgcttgcttctagcttctggcggtaggctacatttcccagcctgtcagaatggcctctctgcaggcttcaacccttatgagaaataaagctgtcctttagcaaagtcatcaagctaagtgtctgtcaacagatgatgattaaagtgtggtacatatacaccatggaatactactcagccataaaaagaatgaaatcatgcctttggcagcagcatggatgaacctggaggccattatcctaagtgaaatgagtcagaaacagaaagccaaaaactgcatgttctcagttataagtgggaggtacacagtgggtatatgtggacatagagagtggaataataggcattggaggctccaaaaggtgggaagatggaaggggataaaggatgaaatattgcctattggatataatgtacattactcagatgatgagtacactaaaagcccagacttcaccattacgcaatatttccatgtaagaaagctgcactcgtggtggtgtatgcctgtggtcccagctattcaggaggctgaggagagagaattgcttgagcctgagagttcgaggcagtgagctgtgattgcaccactgcagtccagcctgggcaacgaagtgagactctgtctctaggaaaaaaagaaaaagaaagaaaaagaaaagaggtggatgcagactggagatttaggaaagccttttcagctcctttctcttgccaagtcttgtttgtggctttggtgggtggttttgtttgggggcctgtcttctttattcccttttcttttttctcttaatcaaagcagtctgttctggtactgcagtgaaacaactctttccagttcctttgcatggtggttgtgcacgtagcctccaggcctgggcttgcatcagtcattttgtctattcatacaaagggaaatttaggctttgttcagttcatctcctaccagggcatgtactttcacagctactgcctgggaagctttgtgtgcatgagatatcaccagtctgccaggctaccaacttgactgtaagtggagagactaactgatgaagcaatgactgtgtgccaggaactgttctaagtgctttatgtgtatgagccagtcagcccactattactgttcttctccattttcaggtgaggaaactgaggctcagattgttgagaaaattgtcccaagccgcacagctggtcaggggcaggccagcattcagtttccagagcctgtgtttttaaccattatgtgatgcctccagggtacattatattcttttgcatgaatgtgcaaaaatatgtcttcatgcttctatttctgttcatttaacttgtttcaatttttttctatcacaaataatacagcaatgaatgtttttgcaataatagcttataatgatagttaacatttgtcgaatcgctaacaaagtgatgggctctgtttcaagttctttatgcatcttaattaatttaatctttgtagcaatcccactattattttttacttatttatttattttttgagacagagtctcgctctgtcgcccaggctggagtgcagtggcacgattttggctcactgcaacctctgcctcccgagttcaagcaattctcctgcctcagccttccaagtagctgggattacaggtgcatgccaccatggctggctgacttttgtatttttagtagagacgggtttcaccatgttagccagctggtcttgaactcctgacctcaggtgatccacccgcctcggcctcccaaagtgctgggattacaggtgtgaaccactgtgcctggcaaatcctactattattactatttaacgaatttaatctttgtaacaaacctactattattaccatttaacagaagagggaaacgaggcacaggacagttggctacatattttgttccagattgcacaattagaaagtggcagcttagcaccataagacatagtgaggaaaaaagaaaaaaaaaaagtggatgggctggcattgaaacccagagctggtactcttatgatagtgtctagacaatatctgtgaccacacctctgattgtacctcaagaagaaagatttttaaagtgaaattactagagcataagatataaacatttaaaaggtttttgatacatcttacaaaagtgcttttcaataacactgattgatcatgctcatttgcatttccatgagcactgtgtaattgatcaaggactctaaaagttagataagccactgataaatggagatgcccctctaagtccctgggcagtaaaacctgaccagcatagcctccaataacctgcatagtgttgaggagagcttggatttaagagattaagagggtcaaactcttttctgtccattttaaaatgcaagttttatttaagaggaactatctaatatgctgaagacagtatcaggtatctgtaaaattgctttttgtaactcagaatcttggaacaaaagaaacaataaagaaaatttggaaccagaactgtttaccctacggaaaatttttgtccaaagcagcctctcagcgttccacatcattttcatcattatgaataacgacaacagcaactaaggtttatgttgcacttttgactgaacacatgcctctttcgtatttcttagaccaagccagtgtttcttgtactttcctgatgataagaagtaccaagaggtgttgttagctagatcgtcataaataatcaggcctcccctaggtaagttctgatttaggaggtctgggttggagccttaaatctgtgttttgacaagcatactaggtgttttttattttctgaggattttggaaactactagaaaacacaataaaattgctgtagtaggttcttttttcaatgttaagctattaacattagaatgcttgcttttaattggaatcaggtgttaaagagaaaatctacaacgatcagtcattgcaacagaagtaacaattatatactagcctcacttagcattcttcacccacactggttccctaaatgtacatttcttaattctcttgaatgtctattatacaggcagatgcaacttgcaaatcacactaactcgaacatacacttcagtgcctcactagaacccctaactgacatctttttcctaagtcagtatacctggcatatgcctggctaaagtgccactttctcttgtttagaccctgaagctgatgtagactgggaactgattactgagatctagacatacctcctcctctcctccacataggcccacccaccaagaatccctacattggaaacccttggggttcaaggatcatgagtctggggcatgcaccctgggatcactgttcagagctgaaaatgcatttccccatggaaacattgatgttgatgtggtgccgttttgctagagtccaagtacattttctggtttttgtgggctgatctgggctcttgctgccatttatcatatttctataaaaaaaaaagctcaaaactacattagggaggggtgcatctggagtgtttgaaatatcccaattcttgttctggatggtgtttttaccctgttactatccctttgtgatattccgttgagctgttgccttaggatttgtgcacttctctgtttttgaattatatttattaaaaatttcaacatatgggggtttgcaagaaaaaaggtttcttaaataaaacccctccatatggaatatagccttttggaaattaaaaacaggcattgaaatctatgattaatataaagaataagaaaataaatcaattatcattttttttcacactgtggatagaagatttcaaaagaaaccctttcatggttccttttatttgttttttcatctgtaatttgagaattaaacattcagtcacactagtcccaagcaatacagttcaaaaaacttttttgcctgtttttatttttttgttgttggtttatgcaaatgaggtttttagctggaaacttcaaaagcctgacacatattaaaaataagcagatttatgatgagtgggatttttggcaagcaattgagaaaaatcaccaagactccaaagagagttgttctctttctgtcttggctttgtcatgtgctctttcttaatatttggtttgaagcagtgtatggttctgtaatgtgacctggagcctctattgagtaagcatccctggagactaagaaacatctttctatgctaatggattagtcaaagaagatcaatgtatcatcatttcaagaaaatattacaagaaagtatgctcttactctaatggaagccagtagcaattttcttgtcaatttcccagctattttttaatattattttagtacttactttcctgtgctgactctatgttcaatctaaaattaattgtttgtcccagttcacttccttagtccctagactccagttgcaactttcatgatattctgttcctctcctgcagagggtttaaagggctgcagaataagagggcagcttgtacattcttttgacaaaaggaggcatgtctctcaatgcttcccttagtttctatccccagaagttctcaagatgaatgtccaagtccatttgtgctactataacaaaatgcctgaggctggcgaatttatagacaatagaaatttatttttagttctggaggctggaaagttcaagagcaaggcaccaggaggtttggtgtctgctgagggctgctctctgattccaaggtggtgccgtgagcgtctttacattgtgaaggggatggaaggacaaaagggcttgctagttccctcaagtccttttataaaggcattaatccgttcatgaaaggggagccctcatgatctaaacacttcctaaaggcaccaacctcttaatactatcacattggcagttaagtttcaacatacaaagttggaggcacacattcaggccacagcaatgagattctgtgagttctttgatttagatgaactttgtttagatgaacttttatttctccccaacatcttaccatgagcacagtcaatacaactgaaaattaagctttgattttcctttcaaagtggctctttttttctgctcatgtttctgttaaatgacatgattttattttttaatttgtaaaatgttttggggtttctgctaattgaattatgggaccctagacataaagaagacataaactccccacggagtatacagggtaataagcagatgaggtatctgtacatgtacagataacccaagtacccaggaggctggaagtgctgtcactgaaatacaaagtatatgggattcagagaaagaggtcattctcatccatgggtaccagttgaaattcgtcaggaacaggcaagatttggacaggggaagatgaagaaaaggccaccccagactcagcaggaacagacacttcaaaggcaagaaagtgcaggtcagttgaaactgagggagtcagtgcaagaattgctgtgaagtttaattttacagcataggaggaagttaagttctaaaaccagcacttaaaaaagagagtcatagtgactcagtgatgcttgacaatctgaacatactgcctctcagtaattctcacaccaccaagatgtccttccagtgttgcaacaaatcatgatttctttgattgatcaccagatgaagcagttggctatgtttagaggctatgttggagagcagggagagacagagaataaggataagaatttatttttagaaagtaaatcacacttaccatggcaggatgttcacacagtcatagccacaggggaaccaagattgagaaaatttcagattttctccaagttctccaaagaaaaatgtacaaagatcatgaataggcaatttaaaggaaatagtaatggttaatgatcatatgtaaaatgttcaacatcaccaatgatcccataaatctaaatttcagaaggaagttattattttcttcctatcatttgcaaatatttaaaaataacactgctggtgaatatgtgtatcttaatttcatgcattgctaatgagaatgtaaattggtaccacctttgtaaaaagcagttgcgtacaagaaaaaatagagactataaatggtaatataatttattcacctattcaattgtaaatatttattaagcatattgtatgtctggcaatggatttatctgtaggcagtggatctgtaaatgatttctattttatgtcttgctctgtcacccaggctggagtgcagtggtgcaatcacagctcactgcagccttttgctcctgggctcaagcaatctacccacctcagcctcccaagtagcagggactacaggcatgcaccaccacactcagctaattattttattctttttgtagagacagggtctctctacgttgcccagggtggcctcccattcttgagctcaagtgatcctcccaccttggtctcccaaagtgctgggattcaggtgtgagccactgtgcccgatctattttattctttatacttttatgggttttccaaattttctagaatatttaattgcctcttatcaaaaacatgcattttaatacatcctttccatcttttaggtcccaagtcaagtctacaagtctaccctttccgtatagtatttcctgggctttaggaagtgctctctcatttttctgtgacccttccaaatgagtcttttcatatatggtcttgagttgtagccacttgtatgtatgactttcttcccaactagtaagggagttactgaagagtaaggattgtggtgtagaaattgtaaatttttaggcaaaagactagttctccttccctaccttctccaggaagccttttctactactcaaagaagaaaaaaaaggtgattacttcttccctgaattctcaaaacagttttttatgcctctattatggagagtaaaacaccccgctttgctttggattacagatgattgtccttgtcctgaccccccccattctgctttggattatagttaattgtgtttatcttaaccatagcacccattagtcatccaactccttactataggaaacgaatctcatatctctgtgtgcccagggtagtgttttacataaggtgtgtgctcagtaaacattggttgatcttatgacagaatgaaactggctctttccagctatttcaaagaggtgcatttcagttagtctggaatccaaagtttcagagtgccatgcaagaagcagacccaactgttgaggagtggcagtcataaagcccgatccgccagaaaaaaacctaccaggaaatgaattcaccttagacttctgatccctcaaataatactacttagtgcctttatgggtcctgagaactttatctgtgaagccctaccttctttgaccatctcacaaacttctaaaaattattttgcaaaagaattccaccttttcattcctaaattgaacaccacagatttgccctgaaacccagtttcaggccctcatcttccacatgtggccattgagagaaaagtttaaaatcaaggactgcataaatattattttagaattttaaaaatgggcctagaacggtagcttacgcctgtaactcaacactttaggaggccaagatgggtggatcacttgagctcaggagttcaagaccagcctgggaaacaaagtaagaccctgtctccctgaaaaatataaaaattagccaagtgaggtggcacatgcctctggtcccagctactcggcaggctgaggtgggaggatggcttgagcttgggaggcagaggttgcagtgagccgaggttgtgccactgcaccctagcttcggtgacagagtcagatcctgtctcgaaaaaataaaaataaataaaatgagtaaaataaaataaaatgaaggaaatagagcacaagattcatttccatttaatacacatttattgtaatccaggattttgcaaagccctgtcctgggcactaaggatgatccagagattaaataggacgttgatctcataagatcccatgtggctatggcaatgtaattgaggaaagggaggaacagtgtaaaaggagttaagagacggggagttcattgcccttgactgcagggttttgagccagaattgggttagaagtgggaaataaataggaaggccactggtaactgctcataattgtgttggtggtgactgctgatgctttgagtctgtgcccagtaaatataagacgtaggtgggattcagatagaatgagaaaagctttaggaaaaaaaaaatcaaagttctaaggcaatattggatagaagatatgatgagagacaggttgttatagaaaaggatggcatttaacaggacacagtgcatctgtgagtgttcttagcttctgacaacagactaactctagttagtctgaaagtaaaagaaatgtattaaagactattaggacaccatcaagaaagtgaaaggacagcccgtagaataagaacaaatattttcaaagcacacatctgataaggaactcacatccagaatgtgagaactcaacaataaaagacaagtttaaaaggacaatttaaaatgggcaaatagtgttggttttgcaacaatgtaaatgtactgttcacagtatatatacattttgatgtaacaaatagtaagttttgttatatatatttaaccctaattttaaaaataaatttttttaaatgggcaaacatttcagtaggcatttctacaaggaagatacccaaatggtcaacaagcacatgaaaagatacttaacattatttgtcattagggaaatgcaaagcaaaaccataatgaaataccacttcacacccaccaagaaattgaaaccctcatacattacttgtggtagtgtaaaatggtgtaactgctttggaaaacagtctggcagttcctcaaaatgttaaacatagaattagcgtatgacccagtgatttcactcctaggtaaatacccaagagaaatgaaaatatatgtcaactcaaaaacttgcattcaaatgttcatagcagcattatttatactagccaccagtggaaacgatccaaatgtctatcaaatgttaaacagataagcaaaatgtggtgtatttatataatataacattctttggcaataaaaagtcatgaagtactgacacatgctacgtggattcctgagtaaactgaaaaaattttgctgagtgaaagaagccagacacaaaagcccacacatattatatgatttcatttatatgaaatgtccaagtgtggcggtgtgcctataatcccaattactggggaggctgagatgtgaagatcgcttgagcccaggaagtcaaggctgcagtgagccatgtttgtgacactgcactccagtctggacaacagaacgagaccctgtctcaaaacaaacaaacaaaaaaaccaaacaaatgcagcctcctctgggaggcctttcttcgtttcctgcttctatgttcctataaccctctgtccatacacttctatcatttcatagtgttttgaaattgtaggtcgtccctccccaccttcccctctgccccccaaagaagataaggcccttgaaagtagactcatgctttttcaagctttgtattctcagccttgtgacagatgaaggaagggaggaaggtaaggaaggaaggatggagggaggaaggaaggaaggaaagaagaaaagaaggaaggaaagagtgaggaagggagggagggaggaaataaggaaggaaggaaagaagaaaaggaaggaaagagcgaggaaggaagggagggagggaggaaatgaaggaaggaaggaaagcgcgaggaaagaagagagagaggaaggaagggaaggaggaaggaaggaaggagggaggaaggaagggagggagggagagggagaaaaggaacgaaagagtgaggaaggaaggaaagagggaggaagggaggaaggaaggaagggagagaggaaggaaggaaagaaggaaggaaagagcaaggaaggaaggaaagagcgaggaagggagggaggaaggaaggaaggaaagaaagagagagagaggaagggtccctactccaacttcttttacggagtaaaaaggcctaaagagacagtcatgacttatcatttgcaggactgattgtatcatacttgactcatttgttaacattcacttgaaggaaacgcagagattttttttcttcgctcacattcaggagctgtgcttgcttataatgaactgtcatgatggaggccggcccgtttcagctctctcagccccgtcaagctgaactcacttcccctgaaaggacagtgtttgcatttgtgtttacgggactggggaagaggatgcgttttcaggagacctgaaaaccgagccaacccccttttcctgccccgctgtgctgcgattggcccatcttggaggctggctgcaggagcctttagtcatcgcacagggaaatctttctggaaccgggcaccaacttgcgtgtttgttttcatgctctttgtgcggggattagctgtcgtgccgggcctgaaaatgctgcgagcgccgggcgacatctaatccaggatttgcctctgcctcgcggttgatggaaaacagatgtcttactgctctgggcctgagcacagaatggaaatgaccgaccagagagccatttggagccgaggacacccggtgaaagccattcagagtccagccaggaggccgactttcctcctctggtctgtttttactacttgagccgctcgctcagaaaacggccttagataaagcagtttcaccttcagatcgcctgaggctgcagaagggcggctgcgggggaggaaggaggaggcggagaggagcgggtgcgaagtcctgggtcgcctgcccgctgcctgatgtcgtgagctagggcacctcggccctggctgggcgcgcagcgaggcccaggcccgaggggtgaggcccaggccactccggagcgcgcgctgttcccgcgaagcgagtcgccgtctcgtagtaagtcgtggctcgggctgtgccctgggaaccctcccgcccgggcaaggtccggtggccggagcgtgcgggaagcctgcccagagtccatttccggacgggcgctgcggggctggcagccggcctggagcgggtgcagtgggtcggcgcggcgcagagctgtcagcaacagggccgctgagcagcagaacctggacgccgcgcggctcccaggccctgcccgcggagctctcccgggagtcgcggacctctgccgtcctcagtcacccgcgtcatgcaggatagctttcaaagtcattttgcagagaaaaaaagatactgagcaatctgaaagcaggactgtagtaattttgaaaagatcggcttcctctttttctttaaaaacatgtttggtcattttcctaaaactactttccttcctttagcctcctcttttattctttgccccagctcgtactacagttcgggcttattagagcagggagatggtgacttttgagggtttgcagggctctttctggttggtgtatgtattctgaaaatacttgcccggtgttgaaagctgcatgccgctgacaaagtagataaaaagctgggagtgtggaggacggttcgtctcactaaatgcctgtcagatccaaagcattctgtgaaccccaaattcgttccgacctgtaatccaaccccatggagcaactgatgccttccaccaggcccctttgctttcccgggaaatcaccagctttaatttatggaacagagacagctttagattcaaagacttttaaagagttaattttagagcacttagaattccagccatccaaagattaggctagccccttagggtgtgaggggttgttcttgcagcagtatgcacatctatgccttttttcattgttttcttctaaaaatggagattaaattttacatcaatatttttagaatgtagttaagagttgttgcctgacaacttgtattgagggttcctttcccagggggtgggaggaggtattgtgctgggtccactgcttcccagctccacgtgacctttcctctcaaatttccacttgatttcatctttggcagaactggtacctgcccttcagctccaagaaacaaaagagcaggggtgagtcagaaggctttgactacctcacccttaactagagatagaaagtacttgattaaattctttgtgatacacattgcatttccttccctttccaacttaggttcatataacaatgaaggatcaattaaaatgaactccacctcccttctcccttagggtaaatatggattcccttagggctgagttgggcagggccatctacactaatgaaaagtcttctaggtgaggtaatctggcctgttctgggctaggtacagaacaccacatcccatttgccctcattaactcattcttttaactcattcttttcctggcagcctcccttttctttctatccttttctgtataatcccatttagctacccaccataactctactttggatcatggaatctaggataccatcactgacaaggtttgtttagatgactgtctcttatcagtattccctgagaacatttttccaattcctgcctttattttcctggaaaattctatgtcgattaaatcctccactagaaattccattgtatctgtcaaaaataagcatcacactcacatcttgaatatttttcttgcatcatcattttaatgctgacttgcacagcttcctgatttctacttcaaatttaaatacaaatggaaggaagttgttataagacactaaatataaatgggttagatagtctcagtgagaattaacatcttattctctgaccttttctttagtctgtccttgggttgaattctatcctttcaatttctgaccattgactactctagaaagaggttggatagttattttgtgtgtcaggaatgatctgtttacttggccttttctgagcagcagttactcactacctctcctagtgctgattggtaagaatttggcctattcaatgatgataactcaacggggtaatatagcaaggccctaggaagctttgaaaatgacatcttgaagccctgaaatcctggtgcaataacattatcagaactttctccttctttcaccactccatgaaaaatgacactgcttggtttatatcaaatatgtcttagattataaattcccaaagacagctttagcttgatttgtacaggtactaaaagtttatgctggcgggtcagcacctggcaaatgcttttgatgctgctactaatgatgaagacaggaacaatgatggttttcctttttggtttcttgagaaaagacttcctgcttagaatgtctgtttgagaggctattctgtgaatgttatcttaaaaggcttgaggcaaaggctggcataatatcatacttagtcccaacattatttcttatacttttacattttagaccttcagcctgacctgttagttggcatgtctgaaaaagtccacctatgagtttaatttagtattttctctggaagaaaatgacaggtcttttgaaatgggtagtatttggtttaagggttaaaagaattggcaagtgcaacctttgagataaataggtagagaggaaattaaggggagtgaatttcatgaccttgagccactatttactagacactcagcttttatgtatggttagagggtttactggaaattaaatctcagaaagtgagcttttgttggcaaatattttgtattactaatatagttatttcctatgtaacgctatattatttttgcatatcctgcctttggttgtttgtggttttacttttttaatttttttagagactttgtcacccaaacttcagtgcagtggcacaatcatggttcacagcatcttccaactcctgggctcaagctattctcccacctcagcctcccgagtagctgggactacaggcatgtgccaccacacccgactaatttttaaattttttgtagagacagtggctcactgtgttgcccaagctgtccttgagctcctggcctcaagcaatcctcctgctttggcctcccaaagtgctggaattataggctcgagccactgtgcctggcctatgtcctgcctttgaatctcatcttaatccttgaacagaaatattctctccctagaattttcaatattttcctttttcataatatactgtatatgtagatgaaatttgtctatgcagaagggctggcccaagagactaaaatgtgttcttgagtctaaaataaataccatatatgtcagcatctttattaatttaagactgtttagaagtgctcaaatagaagctgtggatacaggttttgcttctgtcttaactgcagtaaaacgaactaacctaagacatgctgacttctggaacaagggcaatttgtagaaatatgctgcaggcagttggagttttgagagatgaatacccttttaaactgacatctcttcagtgtaagtgtttttcaggtttcagaatgtctgctgtttgagggacgccttttttagtttaatgcagtcattggtccaacctaaaatattaagagaggcacagagttgctgacctacttatctcccattaggatgaggactagcgttttagtactctcattgctgaccttcggggatgatgactttgaggaccaggaagcaaacaaattggaaagcctctcagattaagactcctgaaaagagagatctaagaccaaaaatgtgaaagattagaacaagtttccttttagaatgttctgcccaatcaggtagaagaaaggaaagataattttcaagcccatgccccagtctgctagccaacaaggatttattgagcaaatactatgttctgagccccctgcttatgatctggaaagtacaatagcctaaaaggcaaagaacaagtcttgaaggaattttcaagtcctggtggtacctttaggcattagtgagcatccttctccctcctgttctctgagctcctcaagtctttcctcagtgaggaaatcagctctggctgtggtagaaccctctgcagtggttcagctacaaacactttctgagagaatcaagttggccccaacctaaaatttgtttcctttggcagtgaaaggtgtgttggtaaaaggctctttcagcattacctggatgaagtggcatttgctacttaaccccaagactcttgttcagtgcacggttctattcctaaaatgtcctctcctcagctaccagacaattcaacagtggccctgggtagcgccaaaataacccatcatagaaacactgcttgagagtgaatagtagataggcttgagctttgccttaattaagaggatgagatcgggtctctttaatcgccaaaatagcctctcagactacacaaagacagaactgtctcttttgctgactacatgcaatttatttaaattagtgttgcacattcaacgatggtgtggaagctatattagaaaaccaccaaattgaatgagttttctaggtctttggttagggataaaaagggcattagccacattgaatgggatttgcatctcgttagcttgcccgtatgtcctcagctattggacacaatggagggtgcacgtctctcttttcagctgggtagtctgcttcagttgtgattctcctgggaattaaaattgtgaactagagtcatggtgggggaaggggaagggctggaacttgtctgaccacaccctcccccgctttttgtagttcaagattataatagtttgccttagcagcagcaaaatctatctcagtgtttagtactctcctcggtattggctgtgaacaatctccttgcagatattgggcagctggctctccttattgttcagcatatgtccagggttccctccaatgcactggattctgcttatggaaggcaaaataattaccatgttagtccaagaaagagattataaaagtgaacctcttatgcgaagtaaacattttggatatccccttatttagcgtgaccagtgagatgtcacccacagaaagtggataaaagggtacccaaatgggctgaaggccacaggatcagctactctctatccataaacacccttgtcaactgtgtggatgcttcatctgacaccctgtccttcctctccttccaagtatgaatcatccttgtcactccatttccttcaccacccaaatcctggccctatacttagtacttcctgagacctctagaacagaagtacccatgggtcctcagccactttaccccatgtgtgggtctgatggctaagatgagctgtcctgaatagctttaaaagtaactccagggagaaaaactaaatgtggctcgctaaaagataacacttaatctatacagtttcgtagagggtattctggatgttcggatctgggttgctgcagaaaacaaatggcaataactgggtatctttagcttctcaatcttagccaataacaaagccagcaatcaaaactcaattcaacagttacagaatatggtctccagactcctgccaccattaaacagaattctttcttacaatgctgctttccatcttataaaaacaatgctttgtccatctgttgtggcacacacgctgtacagcaaatgagccttcaatgataaatgttctcttttgccccaggtcacgcggcagtcatagtcatgtacaatcaagtgaccatttatttagaggaaggatgagcagaggctaactgcagtctttttgctgtttttccctattttctgccttcaagtagcaattagcctttgagtatccttcatccttttccccccacaaatggtgtctcaatctagtaacctcacgtataaagcaaccgatgactgaaggctaaaatccactcagagaccacaaaccacccactaaaacaacaggaaaagatctgggagcctggaaagggaagaggtgggagtgagggtacgtggggccctgtgcaaagtgctggtttttcttgtgacatttactctaaagtctctgcttaagctacagaccttggagaagaaagtatattttactcatttttaacacaatttcattaaaggacaaagaaattcgatttcttagggatttcctctataagcatttttcttgtagtccacatatattgtttcacttaaacaaatattctgaatttttttgtttcgttttgacttgttttgttttgtttgagacagagtctcacactgtcactcaggctggagtgcagtggtgcgatctctgctcactgcaacctccgcctcccgggtttaaacaattatcctgcctcagcctcccaagtagctgggactacaggtcccatgcctggttaatttttgtattttttggtagagacagggttttgccgtgttgcccaggctcgtctcaaattcctgacctcaggtgatccacctgcctcggcctcccaaagtgctgggattacaggcatgagccatcgcacctggccagattctgaatttttaaacagtatctactagaaatcaaattcatttttcttgttaaaaagcctttaaacatcaagaaggggaaataattattaagcatttgcttggaacagttgaagtagtttctgtaatagaaggaagacagatttgccagggtatgaaattctgaatcccatctgcacggaagctggttttcatttgtaatgcagtacaaaatattcttggcatctttggtgcttattgcacacagtatactccatgctaaaactaaatctcgatagaactaaatacatttctttcgttagattttttttctaagcattttctctcgttcaagtcccttggataaatgcattcaccaagtactgccaggtctttctacctctgcagagtttagtcttcaatcttccttattcagccagttcattcagctactatctattgatgggggccgagggggacaggagttcacaggctaacctgagagaagaaggcaaggcacatacacccctgcccgtgtcctagatctgtctttcagtctctaggggcctaggccctggctttctgaattttacacatgatgactgctacggtacttacagcctcaatacgtttgccatccacactatttttttttttttaagagacaaggtcttgctctgctgcccaggctggagtacagtggcttgatcatggctcactgcagcctttgcctccagggctcaagcgatcctcccatctcagcctcctgagtagctggaactgcaggtgcatgccaccatgactggctactttttgtatattttttgcaggacagggttttgacatgctgtccaggctggtctccaactcttgggctcaagcgatctgcctgcctccacctccccaaagtgctggtattacaggcatgagccactgcacccagcccatgttcagtctcaaaaccagtagaattcagttacaaaaacaaaaaacacaccaaacaaacacttgtctcaggcataacatattaccttgttgatttattgtaccacagctggaaatatggggactgtcagtttctcctgagaatctgggatactgcatgccttaagggagattgaggtgacagtatgctatctgtcttttatttatgaagataaccctgttgacccaccaggatatgctttgtagttttctccatccatcctatcaatttttattagttatgaaatttactggcccctgtggcacaaatctagaagaaccagctcacttggttcaagcctataatttcatcaacatagcaggtaactagctgagctcacttggaactgagatcataataatgatttaacctctcatttgagcaaggctttactgtttaaaaatcactttcacagaaataattccatcttatcttgacaatgtccctgagaggtaacatcttagaagcgaggaaactaagtttccaagaagtcaagtgacttttccagtaaagggggagtcaggactcacacctaggatgtctttctcactaaaatacacgctcaagtatacttgattggttgacatatgataaatggatacaagaattgtgggaagctctagaagaaaggatgttttgttgagaaaacaaatctaggaaagtgtctggaaaagtggttttcaatagagattgtttactttaaatttaactctagacccaagaatatcacataggaaaccattagggagtcatgtgaacaagacaatcaagtgtcaactcatatgatacagacattaagtacaatgatggttcagaaaagagagagaacacaataaggtaataaatcaaggataatataattgaggaagagggactaaagttagaacttaaagaatgtgcaagatttagatggaagagggaagtgggaagggcacaatgggcattgggaacaacccaagcaaaggtggagagtcattttccagacagggattaggagccagacacatctgatgggaggagggactgagcaggtctaggcaaggaagtcgtgggcattgaggtgaaataaggaggtggaatcaaagaggatcttcagtgcctattggagaaatacagacttgatgcttaggtgctctaaagggtggcggcatgagggagaatctgctccatgcctctgtcctagcatccggctgtcccacgcttcccttggcttataaatagtgttctgtgtcttcacataatcgtccctccatgcctgtctctgtgtccaaattccccctttttgtaaggacatcagtcatattggattagggcccactctaatgacttcattttaacttgattacctccctaaagacctacactgtacaggttgagcatcccaaatccaaaaatctgaaatgctccaagtccaaaacattttgggtgctgacatgatgctcaaaggaaatgctcattggagcatttcggatttcagtcttttggattgcggatgctcaaccagtcagtatctgcacatattccaaaatatgaaaaaaaaccaaaatccaaaaatacttccggccccaagcattaggataaaagatactcaacttgtagtatttccaaatacagtcacaatctgaggtactgggagacatcaatatatctttttggagggagggggacacaattcaactctaacagccacctttaaagagtcatgagtagccaggcgaggtggctgacgcctgtaatcccagcactttgggaggccgaggcaggcagatggatcgagaccagcctggccaacatggtgaaaccccgtctctactaaaaatacaaaaattagctggtcgtggtggcgcacgcctgtagtcccagctacttggcaggctgaggcagaagaatcgtttgaacctgggaggcagaggttgcagtgagccaagatcatgccactgcgctccagcctggtgacagagtgaggctgcatctcaaaacaataaataaataataaattttcaaaaataaaaaaaattgagtcgtgaccagcacagtgagaggcaaagaggtgttttagtgagagtggactgaccccagcatgcagaatatgctggaaggaagggagggaactagaggccataggttggggcgggggtggagaaaagtagataaaatcaagacacatttcaaaggaagagttgaaaagatttaagtagtagcaatggtaatgtgtcgttaagtctagaacataacagtttacagaacattcccatgtctcctttctcctttgtacctgacttaggggctgagtggtgtcttcagggtttctggccctgggagagaagctccagtgataaggtcagccactccagtgagagtggctagcaaaggcagcagggggagactcagagctgcaggtgctgaattggaggtggtgacagagccgggtggagctgtcccctgggccactggaaacctaagccagctgccccctctctagacatagatttggaagtcaaatgcattccagcagtcatctaatcacaagagtgggtgcggcctctgagtgagtgaatgtaggagaagagcagtggcttgatgttttggcaaattcccggagttagaagattgctaagaataaggataagaagcatttaaagtagaggagaaatggtaaagttctctacttccaaagccaaagaaaaagagtttccagtagaaggtgggaggagaagagggacgactgggagaagactttggtttagctaaaatgaggacatggggaaaagaaagtgccaaagaaaggaaggaaggaagtcagatgataattacagggtggcaggatttagaaaatggtgtggggggtttttattggaaagttgtggggttttctttttgagatattgattactttacttacagtcaaattcaccttttctgatgttcaattctgtgaattttgacaaatgaatatagttctgtaaccatgactactgttgagataggaccaattatatcacccccaaaattctttgttgctgaggtgcttttttgtttttttagaggaaaccaatgtgtatttgaagtcagaaaggaagaaacccatgggaaaggaggagatgatggtgttaaagaggaaagggttgaaggagtgaggcgtggaggtggtagggaggcaggtgggccactgagaatgcttcaattttggtgggaaggaacatttcctctcttcctatgaagtagaaggaaggatggatgcatacattcagggtctatgatatctttttatggttaattccaaaactcctgccagcaaaaccatttcctgctgagagagatgttaaatgttgcattgcataatttctgccacggaggtatgatttcctgttgcaatcactgtttgcaggaattacatgcaaggggagtacaggcaccgggctgctttgctttgggatatgtgcccaaatcctgctctaatgtaataccatagcaattttagaactaacaactttaaaattcttcaaagttaagtgcatctgcatcttttcctgcaccatacagtgagaaagcttggcagcaataatggcttcaatccccataaatactcctgacaggtgtaaatgagtcactgcggaagagctagcttccacagacatgtccttggggcattatttggcagaagagattgaattctcatcattttatgctcaagactcacaaccactcagaagtgcagttttctccttgacatctatgatgttgcttgcatctccctttatccttgcagtcacactgtgattcaggggtgggaggaaagaaggtgttggatagcgattctcaaactgtgggcttcatgagcgggttgtgaatcaagttagtgagttgcagccagtttactgaaaaatgaaatagaataggaaatagcagagggcatcgggctaaatgtgatctcatgcaacctttgtttcagtgaaatatatgtatctattactggactgcaacataaaatacatttctgctgcggatctcagtcacaaaagtttggaaactgaatgtagaagtatgcagatcctttatgaccctaggcaggctactgaatgtccttgtggcttagagtcattgtctgtaaaatgaggctcataagttacctactctgtatggctgttgagagtgttaaacagaaaatgcataggtagcattaggtgctgtgcctggttaacagtcaatgcttgtgatgatgatttgttttcctgcctagatctataggtcaaatttttattcaatgcccagacctttcttctgagcctagaactataactcagcagctatttgacatctccaggcagttgttctacatgcatctccaactcagcatgtccaaagtggaactcaattaattgccactttctctctccaattcttaaccttccccgtgccctgtcccaccctcgagcacacagacccctctgctgcccccagctgtgtacttcatatgtggtgcttccaaactgcttctagttggtcttcctccactaacacacatatgtcttcaggtttcctctgccttgaatgcttgttccacttttttgttgtatgactcactctttcccatccttcagggcttaatacaaattggttttccagtcagaaagatgtaggcttgaagtcactaatcattggtgacagctgtgtgactctgagaagcaaatttctgaagcactcaaagtcagtttgttcctctgtaaaatgggaaaagctgtgcctgcttcatagagttaagataattttttttttttttgagacaaggtcttgctctgttgcccaggttggagtgcagtggcatgatcacggctcactacagccttgacctcccgagctcaaggaattctcctgcctcagcctcccaagtagctgggactacaggcaggcacaaccatgcctgcctaattttttgtatttttcatagagatgaggtttcaccatgttgcccaggctggtctcgaactcctcaacttaagtgatccacctgcctcagcctcccaaagtgctgggattacaggtgtgagccatggtgccccgccaagttaagagaattaaatgaattcttgtgtgtatagaatagtacccagcacatacagagtagttaataaatggctgtgattctttttcatttttaaagaaggctcaattcacctctttctagagcttcttacagacctgaatgtgtcaggttgttgaagagctttgcagttttgcaccagctattccttctgatcagattaccttttccacacttcttcctttgaccaagccctactcctccctcaaggctcaacccaagtgtcacctcctccgggaccctgccaacatcctgtgctcacctccatcagaattcttgaccacctaaactatgattaccttctttccccctagattctaagtctcctgagggctccatgtgacatgtgtcgtgggagggatccggtggggatcaaatcatgggggcagtttcccccatgctgtactcatgattgtgagagagttctcttgagatctgatggttttataagcatctcgcatttctcctgcttgcactcattctccctcctgccaccctgtgaagaggtgccttctgccatgattgtaagtttactgaggccttcccagtcctgcagaactgtgagtcaattaaaccttttttttctttataaattacccagtgtcgggtatttcttcatagcagcatgggaatgcatggatacagttaaggccatccccaacatggcttctattgcatgttctagccttttcttctacttatcctcaccttgtacctcataccatggaaaactaggctccttactccctcactgtgccccatacctcatttccttgtatgcctattcatgctggctctttctgtttagccccacaaacccactaaagccctctcaaatgctaccacatgacaattctagaacctttagtgatctactttttttaaacaaacagtagtagttgtcctcaattctgctttgcatcccacagcaacccactatggacttttcttgtggagaagattgtcctttatacagcagtttctttacatacttgtttttttatggcaagttgtttgagtctgaggattgtgtctttttcttttcttttcttttcttttctttttcctttcttttcttttctcttgagacagggtctcactcttgtcaccttggctggagtgcagtggtacaatcacagctcactgcagcctcgacctcctgggttcaagagatcctcccaactcagcctcctcagtagctgggactataggtgtgtaccaccatacctggctaatttttaaatttttggtagagatgggggtctcactatgttgcctaggcctggtctcaaactcctaggcttaagcaatcctcctgcctgggcctcccaaagtgctcatgtaatatgcatgagccacctcgcacagccagaggattatgtcttaaacatctttgtaaacttacagtatcaaggacattacattgcttgtcttttctcataagtgtttgaggaaacaaatagaattgaaaatcagctagatttggttgtgctttctgcttgctaatttaacttttgggggttggggtgtgggaaattaaggtttaacttgtcttttgactcttaaatatatttcttctacatgcaattggagctggagttgctacatttagcaattaggcatgtaaacattagtaccatattataaccacattgttgtaggcatttttgattaattgattattaatattaattttagtactaatatacctttaatgctattgtttatggctcttagttacttaggagtgtgcatactaataaaaagagtcaagaggccaggagcagtggctcatgcctataatcccagcactttgggaggctgaggtgggcggatcacgaggtcaggagtttgagaccagcctgaccaacatagtgaaaccctgtctctactgaaaatacaaaaaattagccgagggtggtggcaggcacctgtaatcccaactactcaggaggctgaggcaggagaatcacttgaactcaggaggcggaagttgcagtgagctgagattgcgccattgcatttcagcccaggcgacagtgcgagactccgactcaaaaaaaaaagagtcaaaatatatgaaatgtgaaaatgtaaatacataaacacatttatgagtggtagttgtatacatacatactttctactttatcaaagtcaggacatctatgaatggttatacaaatggttatacaaatattatacaaatattacaacttaattgtatctttttttcaaaaaaacagaagatccattggtagtatgctctccagctccctccctctgtgacttacaccttcgctagtcatttgaaagcttctgtgggagtgtgtggtaagtgacctgccattgtggggagtggaagtggcatgacctcaggagccagttctgagtccaggtgaaccaaagctcagtttctttcatctttgaacctgaacctcttacctccaagaaaaagggcccaggaatttgggccttcttgtttatttgtccttctgcccctctccctatctaacccctgggtaagggtgagcttgaaggtgatggtgacagtggcttctgtgtgtgtcagtccaccctccaagcaatgcttagaaaccagtccataagccaattaacacatcatttttagggcagatttgcaagttctcagttgtttacatgtttcgttaagtactaacctccaaattaataaagcatgacacatgacatcacacatttcacaatttgtacccaagcaaagttcatggaggtaaaggtaatgaattagcggttgtgaaaaatcacacattcctttactggagacaggagagacatgtagaatatattggcaatgaccaaaaattgacttctaagtacttttgagattggccctgggaagcatcgtatgaatctctggcaagggaagaaaggactggactccagggagaggaaaagcatgtataaaggtataacggtttaagaaaaagagagaactggaataacccaggattctctggaggcatagaatgagtgcattttaagtcttttaaagaagacttgttgtaaggcaacaagcctggagccaagaaatgtagcaattccagctccagtcgcatgcactagacctgctgtgcttaaatgtcctgtgattgggtcatggaattgcagcatgtccagcacttgaagaggtttggatgctttaagtcactgcaagaggccaggagatggggtcacagagacagaagagacagactgtcttgtacagaaacctaagggctctctattatggactgaatgttcatgaatccccccaaaatcatatgttgaaggcttaaccccactgtgacggtatttggagacggagcctttggaaggtgattagggttagataagatcatgagaggtggctgaggccttgttgacaggattagtgctcagtctccttagttagaaaataactctggcggccgggcgtggtggctcacgcctgtaatcccagcactttgggaggccgaggtgggtggatcacgaggtcagatgatcgagaccatcctggctaacacagcgaaaccccatctctactaaaaatacaaaaaattagccaggcgtcgtggcgggcacctgtagtcccagctactcgggaggctgaggcaggagaatggcgtgaacgcgggaggcagagcttgcagtgagccgagatcgtgccactgcactccagcctaggagacacagcgtgactccgtctcaaaaaaaaaaaaaaaagaactctggctttgatagaattgttttggagattttatcataaagatagtgctctctctctctctctctctctctgcctttctgttattttctttctattcctttctaactaagagagaaagttatcctctatttgtaagtgttaaagaatgcaatcaccatgatactgcttcacatcccctttagtgtaaaagtgccttgtgtctagtaagcagttgcatcatcattgcatgaaagtggaataaatgaatgaatacatgaatgttagaagtaagtggcctgcaccaggttttcttctcgttctgtcttcttctctcttgcctttcttgttctcctttctcttcaacacataacatcttttattaggtatatacatgtctcctttgttcgtctttgccttaataagaaacaacattttcgagcaatatgaaatgtctatgcatgacagcatcctaactttctttctcttttttttttttttttttgtaagatggagtctcgctctgtcacccaggctggagtgcagtggcgttatctgcaacctccgcctcctgggaggcaggctcaagcaattctcctgtctcagcctcccgagtagttgggactgcatccacgcgccacacgcccagctaatttttctatttttagtagagagagggtttcaccatgttgcccaggctggtctcgtactcctgggctcaaacaatccacccgtctcagcctcccaaaatgctgggattacaggcataagccaccacgcctggccagcatcctaactttctgcagcagtaagtaggatccctaataaaggctgaatatcatactcatacccacaattccttacttggtttaaatacaaaagattatcgctgccaaactgtgcataagaattggtagactatgtttgaaaatgttttcctttaataatattgcaaatacctgaagccaggcaataaaagtaagacacaatatcttatttggtagtgttttcttttcaatattgttttcagactcccagttggaaggaagaggttttgtatcacagtttatactacatatttgcataaacagtaaatatttttctcctacttaaaacaaaaatcaaataatgtttagtaattagactaccttcagccactgtgaaaggacttagtttagggtaaatggtgtcttttcctacactgcttctattatcagtagaaggttactacctacgcttctagggctctccagattttaacagctcatgaattcagaatacatgaaaaagcaagagttaactacagaatatttaaacagttgttttaattttattacttccagtatttgcatgtatccaataaccatataaccatgtaaatatattataaagcatacctcaatgactggaggagaatattttcagtaagtatattaaaatcgtttccctggccgggcgtggtggctcacgcctgtaatcccagcactttgggaggccgaagcaggcggatcacaaggtctggagtttgagaccagcctgatcaacatggtgaaaccttgtctctactaaaaatacaaaaattagctgggcgtggtgacgcacagctgtaatcccagctactccggaggctgaggcaggagaatcgcttgaacctgggaggcggaggttgcagtgagccgagattgcgccactgcactccagcctgagtgacagagcgagactccctctcagaaaaacaaacaaacaaaaaaaccttttcctgtagagtatgtgtcactcttaagtaggttaagatgatcttgcttacacctaacagatcccttctacaagagctcaaagggatctttagcagatgtccgatcataacaagtagttctgaggtgtctcacaggagtacctggtctaggaggctgtgttctccagagcagcgttgatcacacagctctggctaatgtctaggcaggctggacacccagtccttcctcatcgcacattgttggaagccatgtgccaagactgcatttgtgctgcaccatcgttgggggatggtcctgccccctccccgatggaggtcacaggtttgtgggcgagacacctctaactaaacaaacaaatattcctttacgaactgtgacaactgccatgaaggattcaaagggggcagagtgatacataacaaaggggcacacccacttaagtcaggagggttaggaaggcctcagagaggaggcagcatttgagcatgtgagcagagaacccaggagcagagaacccagggagcaggagcaacagcagggctaggaggagcgggaaccttgcattaagagcgcctcgttgctcatgaagatccattcatttagccatgaactaaaacaaggcggcctccttttctgaacttatctcagaatttcgacctgaggaaacgggtgcacagattcttgaaaagccagaaacagtacagagagaacggaggagaggccacacgtatgccggataaaggtcccaggatgctgctaggagagcactggccattagagtaaacagaaaaatagaaatgaaacctgtttttataatgaataacttttatagtctaagtttaaatgaagattgggttttcccatttctgggggcaaacaaacatgtgttaatagctaattaaaaatagaatgggaattctactgaggcccattatggaacagggggcaggcaaggtgctggaacatgctggccatctgatgccaaccacgtgggtcctttgaataaatctgtgtgcttttatcacttcaccctgctcaccaatttgaccggattaaaaggcttcataacagtctgcacaactgctaatgatgtaactccgctcttacatgtttattttagtgttggatttttattgttaaggtcactccgaggatatgcggattcttaactacacaaagttggtacttagccttggtctattttgtcttgtatcttttttttttttctttcctattcccaggagtctgccttctctgtgaatccccctctaacaggatgtcgtggtttatttattccctgccctttgccatgtggatgggcggatttttaaccttttagtaccataatcctttgtggtaggttcctgtttctctgctatcttgggaactcctgctgttcgaccttggtgtttgcatatttataaactcttaaccattaactcttcaagcagaccagctgcagcatgagagctatttgctattcctcagcatcgttttctagtctcacttagcaagacctttgcttgttgtattcccatttgtgtctgttgtggaacaggctcgacagaactactgaaattgtaaagaaactcaggcagcctgcacagacctccagctccctgggtctgcctgtaaagagaggacgctggggcagatggagagcagcaggcactcggagttaggcctgagatctgcgaatggctttgccacttgcaggttgtaaggcatggtgggggctgggatcaaatcacctccccagctctctgtttctttgtctatacaatggtgatcaaactggatatctccactgagcaccaggtgtcctgaagagatgggcgggggtggaggcagcatgagtgggaggtgagcatgttggcaggggccccagggcccgggcagctctctagagaaaggatttcatggctttaaaaccacaggactctgtcacctccaaggtcctttccaacttcaaacacacctctgattctatgaaaggatgacagtcttctgccttcctgcttcattactggtggagaggccctgccaaggcaaggagggaagtggactaggaggtaggcctgaggctagggtggagcccccaagcttcctatcagtaccgccaaactgaactgaagccccccacacaattggaaagtgatagagaaggtgatggagtttatgcccttgattcaggttgttgggtttaaaactgaagatccacatgaaggggtgactcttttcgttgagagagtaccagtgctgtgccatgtggcagggcaaagacgaagagcagtgccaggttccttgactgtgggctttgcttcttcatggctagggatggggagcactggatgcagttacatccttgctagatcccagatcctcactttttgcttttgacagaagtctcaggtaatagacttgctttctttcttcagcagatagtagttaaaaccaagtggcaacctgataggcagccagctgttatctatgactcaaactattaaggatggagacatctgtacctgggccatgttcttcccagaggagagcccttactaagtcagagggtattattgtgacatctgaccttgaggacagttcaacatgtcaatcaggctagataagcaaattctttatctagtaaaaatggctaggcatggataatatgtggtttcttattctccttcctcctccccctcctttttttttttccccccccccttgagacaggatctctcattctattgcccagactggagagagagcagtggcacaatcactgcttgctgcagcctcaacctcccgggctcaagtgaccctcctgcctcagcctcccaagtagctgggaccacaggcatgcgccatcacttcctgctaatttctaaatttttttgtagaaatggggtctccctatgttgcccaggctagtctggaaatcctagcttcaagcaatactcttgcctcagcctcccaaagtgctgggattacacacatgagctactgtgccactgccatcttcttcttcttcttcttcttgttcttcttgttcttcttcttcttcttcttcttcttctcctccttcttcttctcctccttttccttctccttcctcttctcctccttcttctcttctccttcctcttctttcctcctcctcctcctcctcctcctcctcctcctcctcctcctcctcctcctcctcctcctcctcctcttcttcttcttcttcttcttcttcttcttcttcctcttcttcttcttcttcttcttcttcttcttcttcttcttcttcttcttcttcttcttcttcttcttcttcttcttcttcttttaattagagaggaggcctcactatgttgcccgagctgatcttgaactcctgggctcaagcaatcctcctgcctcagtctccaaagtagctgagattactggtgtgtaccactgcacctagcaacacatagttttttgaagatgtacaaaaatttgattcttggaatggatttataagaaagctttgcatttcctctgggttgagggaaacaactttattaattgcagtgtctttggaacaggtacatattttaatattattagagaaagaatttctggcctgcaaataattggatatgaactagagaataaatatcttcctacattgcaggagaaagtaaaacataacatcctgtttctatccacagatacttaagagggaaagggagaaggaaaggaaagaatggaattgggaattacatggcataacttgggatacctgttttacagctaaatcatttgtgatctgatttccatgttggtgggacttggcctgtttctggcaggttcctcctgccttccctcattttccccagctttcttcattcatcacaggttcttttttctaccatcttctgtgggtaaaatctagggggcttgtgaccctctgagatggttcttgctgcacgtgtctgtgcacagcactgagaagcaaagtacacacacagtcagttcttgcaccagtcaggagcagcttgcctccacctacaaaacacagggtgatcatgcgtctaaggaactgattatcttttccatttcttatcttctgcacaagccaatggtaagttctgtttacttacttatcttggcttatgcacaagtaaactgtaggtattgtttttcatttacgaggtttttgctatccttgggttggtttataatgttgttagtcagaccaggttgtgtcttaatgtccagacagtgagttagggtattacagacccaccaactggattttcctctgaagcaaaatctactaaaggtgtgtcagccattttgttaggcttgagcaggggcgggcaaactatggcctgtgagccaaatctggcccacggcctgtttttgtacaaccagtgagctaatgatggtttttatgtgtttaaataatttggaaaaaaccaacagaaaaataatattctgtgacatgagaaaattatttcaagtttcagtgtttataaatataattttattgaacacagttataatcattcctttaacaactgttatttatttgtttgtttatatacttatttattttgagacagggtctgtctttgttgcttaggatggcagtgcatggtgcaatcacagctcactgcaacctctcctcccgggttcaagcgatcctcccacctcagcctcccaagtatttgggactacaggtgtgcaccaccatgcacggctagtttctttgtattttttgtagagacagggttttgccatgttgcccaggctggtctcaattttctgagctcaagcaatctgcctgcctcagcctctgaaagtgctgggattacaggcatgaggcaccacacccagcccctttacctactgttaatggctgctctaacactacaataaaattgggcagttgcaacggatactgtattgactcacaagtcaataaagtgtttgctatactggccctttacagaaaaggtttgctgacctctttgcttgtataattaaacagcaacaatagttcacatattttgagtcttcctatgtgccaggcaacgtgctaagcatcttttgggcattgtttaatcctcataacaaccctataaaaagtatctcttttaaaaagtaaaaagtatctcttttactttttacagatgaagaaaaggagggtaagagaggtggtgtaatttggccaaaatcacactgttgggcagtatcagagctgggatttgtacccacatttgtctgattccagagcctggattcttatccaccacagaacaccaacatgcctgtatttcctaggtgggtctgaagtagaggccacagataaaaattgttaattgtctgaagcttaattaacttctatttcaagtaatttaatttagtttattatttgagatttagtatctgtctctgttatgagaatgtgtacattccttaaggatagtgactatctgtggctcctaacacagtgcctagcacatagtagaagctaagttaaaaatctgttgaatgaagtggatagggagtaggaaagagggtgggagaaagggggaggaagaatagaggatgagagacattatcaaggaagagtcagggtgcctagcattggccctaaggtcatggatggctctgcttggcactgggctcaccctgaccaagggctcacaacaccctcgggtcaggcctcacctgaccgtgcacacattccatctgctgctgcttgacttctattcttccgcccttgctcttcccctctgcctctggtggccttgtggcttcctggcactggtccagatgcaatgccaaccttgagaggcgcatcaatgtttgtttagagtgcattcatttggaggaggatgtggaagtgaggcctcccgttctcatgtccagagacgatgacttacatcaaagggcaaaactgacgctggaaggggaccaaaaggaatcatttctcttctgatctttttaagaaggctgctggctctaagggagagatgctggccactgaggactcatttccacaggccgctgaccagcacaaaagtccaggtttctttctcatgagaaccagtggcaggtaggcatgaacagactctcttccttcctgggactggcctgggactagagttagtgtgagacctcagcaagagtaacaaagtagcactgcagcctctcagctgtgtcaaaaacagcagggagacaccagtgctaagtgggtgaggatgcagagggaggctgtgtccagcctggtgtgataaaagtgtttaggcaccaggcgcggtcactcacgcctgtagtcccagcacttcgggaggccgaggcaggcagatcatttaaggtcaggagtttgagatcagcctggccaacatgccaaaaccccgtctctactaaaaatacaaaaaaattagctggacatggtggcacatgcctgtaatcccagctactcaggaggctgaggcaggagaattgcttgcacccaggaggctgaggttgctgtgagctgagatagcgccaccacactccagcctgggaaacagagtgagactctgtctcaaaaaaaaaaaaaaaaaaaaaaaactgtataggcatatctcttctgattttgcatgattctgctcgctatcatttattgatgtattttatttggcttatgaaaaggtgatgaagtgtagtgttttattaaactattcatatgcccaaaaaaaccccacaaatgcttactgaatccttaaatgagcccagctccaggagtaaaaaaagtgaattatcagtcatttctaaaggaactcataaatctagtagtggccataataatgatagtaataatttatgttctgactgcttatgatgcatcaggcattggatcatgtgttttttttttttttttttgagatggagtctcgctctgtcccccaggctggagtgcggtgacacagtctctgctcactggcgcgtccgcctctgggattcaagcgattcttgtgcttcagcctcctgaatagctgggattacaggcgcctgccaccatgcccggctaatttttatacttttaatagagacagggtttcaccatgttggccaggctagtcttgaactcctgagctcaggtgatccacctgtctcagcctcccaaagtgctgagattacaggcgtgagccaccgcacccggcctagatcaggttctttacatagactaaacaaaccatttccttctcctaacaacgctatgtagtcagtacccttgtcatcccccgtacacttgaggtaattgaggaatacaggttaaattacttacccagggttatacaacttgtaagtggcagagccaggatccaaacccattcttggctctagagcccatcctcttctccactaccgcacctgagacttactgtgtgttaggcatggggctgacagtgacacactggatcatttaatcatcacaatggcattaggaggtagcattttacaaacgagctaacagacaggcaaggagcaacctgcagataaagcaaatccagatatgtctccagagcccgtgccttaatcgcagatgcattctgactttcatcataggattctaatcgtggatgaaagtgaccctgagttgtagtgccaggcaggttgcttaggaaaatactcttctggtaacatgttggaggggcagccttctgaggatggtgtcagattcccctgtcctctgattagctccctctgccaaggtgcccaggctcctacttcagtgtcacctccaggtttcaaagcatggaaacccaagcatgttactcggagaaagtcccacccccagcatgggcgcatcggcttagaaccctccagggttagcaggcaaagagctgtggaccccggacacgggaaaaggccacagtcgggagaactcctgttgctggagggccaggcgggggcgatccccagggctcccagcttttaatgctgtcaccgcgggccttactccctcctcttccccacatcgccaccacttgaatcagttcttttacaaagtggttctatttcctggtgagacaaaaaggttagaaaaggaaacctagagggggtgggggaaagacagaggttcggaataccggcgcgcaatcgccatctgggtggaggggacccgccttcttttcttccgcctgagcgcagctcggctcccgcctcggggcggggcctgttgctatggagcccgggccccggcagagcctgcggggtgaaagcccctagggctccgcctggcatgcgtggccggggctgtctgagatttccccaggtcggtggttatgaccgcaggatggaatcgtagaggtcgggtgatttggtcagtagagaggaacatttgcgaggttctctctgaattacatgttggtctaaaagtaatccactatctgggaccgagaggaaagcatgtgtggaagaggcaggcattattagcagcgcgtccgcctcggccacctccctgctcccgcctcggccacctccctgctcccgccccggccctgggggcctctgttcagcctccaccagctcagtcgcccacggagactcccgaactcttaaatcccagccctgtagtcaaaaccactgcattaattaaacaaggtaaactggtgaggcaagcaggaacttgacaccgccttgaatttaattgttaaaatgagaagtgtggtaatggagctctgcttaagagaaaaacaatacttgataccgatgtgcacatcgatgtggacacggatgcaatcaggaacccatagttagcaccgggagattacattccgggtatactcaagatagatagagtcaactttgaattctcgaggccaagcaatgggcgaaacaaaagagctttgtgtttgcgtgcttttgctttttgttacagtcagagcaggacaaagaataatgaaggagtagacatgttattacttgggcatttaataatcagtgcatggcagagccttgtgttttgcttgtctttttttttttcttttcttttcttttttaaagacagggcctcactctgtcacccagactggagtacagaggccccatctcagcttactacaacctcagcttcttgggttcaagtgattctcctgcctcagcctcccaagtagctgggactacaggcacgcgccaccatgcctggctaatttatgtatttttagtagtgacggggttttgccatgttgaccaggctggtctcgagcgcctgatctcaagggatctgcccaccttggcctccaaaagtgctgggattacaggcgtgagccaccacaccaggcctacttcagtcttttctacaaaactacagaactccctatcaagagtaatgctagagaaggaatattaatgggatggtttgttagtacctagaaaaaaaagcatcctgagttccataagaataaatgataccagaccaaccaaaattcctccttggatagggttgctgggcatgaatttatgtccaatatgagtcaatatgagaaaagtgccaggacctcagaggtaattaatagaaggatagagcctggagcaagcaaagtgatggtcttgctctgctctgtgctgggcagatcccacctggatatgtcttcagtttggggcagctccctgtgggaaacatactgggcagggagtcaggggtgcttgacctgggtcacctttactgcaaatacagcccggctgcaaagggctatcctgatccttgagactctgagctgaaggcagataactcagtccccaggagtgattttgagaggttctgtttgtgtcatttatttttttgtcaccagtgccttgtataccacctggcacacaatcacttgtgcaatgtataacattaaagggtcatctgaaggccaggccacttctggtgtgaattcttgggttggaactgggtcagctggttcccaattaatctactcctatccacataaccccaataggttaaggccaacttgcaccttttctcttttaaggatgcttaagagaaagtcctttctgcttcattcaccattacttcctgacagtcctgtttgtccttaaaacctcccccacagccactaatgaatgatcccaacccctaaacataggaggcctcaccagggctactgccagtagagaggaaggggctcggcctcttggggtccaaaccaaaccactcaatcaaactgactacagagagtctggactgtccagaaggagcttggctttgagggccacacctggagtgctgaactgtgaaatccatcataacaatacttcctctccagttgctcatgactgaactgaaggctggaaataattacttcttaccatcttctttcataaaaccattgggcaatacttttcataaagtttttatgtttgtttttctttatatctttaaaatttttttctacttgacatgttaatgaggtacagtgtgatgtttccatatggatgcacattgtgtaataattaaatcagggtacttagcatatgcatcacctcatacctttattatttctttgtagtgagaacattcaaaattctctcttctagctattttgaaatatgcaggccaggtgcagtggctcatgcctgtaatttcaacactttgggaagctgagatgggcatatcacttgagcccaggagttctagaccagcctgggcagcatggcaaaaccctgtctccataaaaaaatacaaaaaattaacttagcatggtggtacacgcctgtagtcccagctactggggagactaaggtgggaggattgcttgagcccaggaggtcgagcagcagtcacgccactgcactcccactccagcttgggcaacagggtgacaccctgtctcaaaaaatacaagttaaaaaatgaaatctacgatacattattgttaactgtagtcactctactgtacaatagaacaccagaacttattccttctatctaactgtagctttatatctgttgactaatctctccctatctgcctcctccaaccccaataaagcttgttgaaatcagagacacagaaaatgaaatgattgcattaggcagcgtttataagctcctgatttgtttgcctcttctagttggttatatctatctcacactgaaacacatcacctctctacttagctggctttgttctactctggagttgcctgattactgttcctgttcttgcacatcctggggcaggtgacatactgaaagaggaacggtgccagccacaagacctggactctagttcacctctattacattatggttactccatcctgggctggtcactttacctttctaaatctcaatttccactaaaataacaatgcctgctctacccgtttctgggttagctttgaggatcaaagagaaaatctatgaaggtactttcttttttctgagatggagtctcactctgtcacccaggctggagtgcagtggcatgatctcggctcactgcaacctctgctgcccaggttcaagattctcctgcctcagcctcctgagtagctgggatcacaggcacctgccactgcacccagctaatttttgtagttttattagtgacggggtttcactatcttggccaggcttgtcttgaactcctgaccttgtgatccacccacttcagcctcccaaagtgctgggattacaggcgtaagccaccactcctggcctatgaaggtaccttctaaatcataaactaccagatatgaagaattgcctatccataacagtctctgatccaactaattctgagatgaactttcacctttatgtcatattatgtcatttgttcattcatagaactttcatcattccctatctacttattgggcacctagtatgtgacaggcactgcactaagggttagtgaattaaaggtaaaagatggaaccttcaacagtttctagcaagaatgctgtggagtacacaggagtggtactcaatccagactgtgggtgggaggatctgggcatcagaggaagactcagagaatccttcctaaagtgagtggtggctttgctgagttctaaaggagcgcaagaagttaaccaggggcaggaggcaggagaggctgagagtgttcctggcagaacaagtggtaagtgagcctagagattagtgtttctcaaaggagatgctactgacattagtgttgtggggacagatgtacttttaacgtactctcccaagcattggagcaggtttggcatccctacacataggcactaaatgttagtagttacccacccccacacacactgggtatgacagccatagtgccccttcacatttccaaatgcacaccctactaccccatgggaggggttggtaccattccttggctgagagccactgctaaaaaaatacatgtggaactgtcagaggtgtttgaacctgagcaactccatcttgaataggagtcaggtaaaatgaggctgaaacctactgggctgcattcccagatggttaagccattctaagtcataggatgagataggacgtcggcacaacatacagaccttgctgataaaacaggttgtagtaaaggagccggcccaaacccaccaaaaccaagatggcctccagagtgacctctggtcctcctcactgttacactcccaccagcgctgcgacagtttacaaatgccatggcaatgtcaggaagttaccctatatgttcgagaaaggggaggcatgaataatccaccccttgtttagcatatcatcaagaaataaccatgtaaatggggaaccagcagccctcagggctgctctgtctatggagtggccattcttttattcctttactttatttataaacttgcttttactttgcactgtggactcgccctgaattccttcttgcaggagatccaagaaccctctcttggggtctggatcgggaccgctttccagtaacagaatgtcttatgaacagagtgtgactagggaggacagaaggtggaaaataatcaggaagcagatgccggattgtaaattactttgtatgccatcctaagatgttcattttctgggataaattttcttgagcagggataggcagactgtatataaagtgcattggattgaacttggcacatcatacagggtcagtaaatactggatcgctatctctcatgctcctgccaatcccaatttagtagcgtacatcctcttcttatgcataggcactgtctgtatacttctccagtgcacaaatcatagtcagactggctgatggcagtttagctctaatctccattcagctggatggaaacagtggggagaggcaagacagctccaagaagtcaataaggtgtgcagtggctgtaatcccaagaatcctgggctcttctctgcccttgagacccccgagtccggccacttgaggccacaatatgggaaactccaactcagaagcataaccagcagccactattaccatctacctacctgttttcaggaagtgccaaggagatgatgcttggcatttccgtgggggcctcccacggttacccaagccccaacttataaacagttggactcatttgccaagacatatgctaaaaatgaggctgcattttcctataataagcaatattatgtgtgtttgttagattcacagctgagcccccaaaacccatttaacccatatagtagttaagccattgtggtgagggtgtttgaaacccagctatcctatgtaatgctatttccaggggaaaaatattcccaattccaggtaaaagatcagaaacagatatcacctgcatttgttccacctttaccccaggcttcagctatacttaggtattactcgctggtcccatgaaccatctcatgcctttgactgtgctgcactcagtgcttgaaatgctccgcacaccccgcacacctccctggccctgtgtatcccttctatgggcgcccagagcatttgcttcctcttgctctcaagcatttaccactctgcattgcaattgcttgcttactaatccatctcccacactagattgtgacctccctgagggctcagaaatattaaattcttctctgtatcctcattgcctactcagtgcttggaacacatgacactcaacaagtcttcattggaatgaatgattgaatgagtaagttaacatcctctggctggaagcccagcaacaagaccaaagatctctcccacttctccaccttcagaaaacagagacctggtctagttataggtctcaagaatctgggttgactggaagaagagaatgagagagatcaggacaaagaatgtgctggggggcggggtcagcatttgatgaatttggctttgggataggcttagtagcagaatgagaagaagaaaggactcctgttgtagtaagtcagacacctgtctgatggcctgtcttaggcttgtaaaactcagtgggggtagcctgcttccagttttagaagtgggtcctaattaaactgtaaacttctaaagcagaacatacgtccgcacaaaaccttgtgcacaaatgtttatagcagcactgttcataatggccaaaaagtggaaacaacccagtgtccatcgactgatgaacagatgaacaaaatgtgctaaattcacgcaatggaatatcgttcagccatacaaaggaacgaaatactgacacatgctaccacatggatgaacttggaaaacattctgccaagtgaaaagagcaagacacacaagaccacatattatatgattccattccagaatagggaaacctttagcgacagaaagtagattagtgattgcttaggactgtggggatgtgatgtgggagggaagagagagatagctaaagggtatgggttgggtgtttgtttgtttgtttgtctgagatgatgaaaatgttccaaaattggctgtggtaatagttgcccacatctatgaatatactaaaagccattaaattgtacactttaaatgggtgaattatatggtatgtgaattacaattcaatgaagctttaaaaaaatccacaaaacttctaaaatagggtgttaactgggattttgagaactgtgtatcacctaaaatggcacgccaaagttggcatgtatgtgcatttctggggtctgtcaattttgctgtattctctgtgatccccctcctcctactaccaccaaaggtaatcaccactgctctgcagagctgaggccccttcaagggctcactgtaatgcttgactgcgtggaaagaatgtgataaatattaatgtaatcaaatatgcagatgcccagttttttaaaataaacattattagcaatccctttgaaactaataactaaccaaggaataggatgcaatactgttccctgcgtttattgttgtagaaaaaggaacggttgtgaattctactctgatatgtaagattttttattctaaattattatttgtaatatggagacctaatcactatcatatggctacttgctgatcatttttacattatttataccttttacaactaagtttaatgacttggcaggaaattaagttatgttatttgtcaagtttctcaacttttaactgaaaacttcatgatcagaagaagaacaaggtctggttatccccgaatcaaaatatgtaccatatgatttttctctgaatcattagaaccacaaaaagcaaagaaatgtcattgcatgatttgactttgtggaaccgtactttatagaccctgccctggggtaaataccaagagaggaaaagtagtaggggcttgtggaactggactgtttgtttgtttgtttgttttttgcatttaaaaaaattatgatatgtgtttaaagctacttgagacatctaaggaaatcagtcgtctctctttctaacgagcaagtgtgtgctctcacactcacgcaaagctcttctctaaatgtgaacttttcatattgaggtaccatatgcccagtttcttcctagaatctattctcactgcgttcaccgtttgcgtcccagcactcccttcgtctgatttgtagcactccctgtacctgccccggctgcgttgcacggagactgcactggtcgcctctcccctggtgaatcctgcagtcactttctggtgatggagctcagcggcccagcacgagagcatggaaacagctgactgctgactcagagggaaagcaagccacccacgaatctcattgcagctcgctgctgcatccctatcccataatcccttgcctggtttgctgcagtcttttcaacagacgctcagtgagaaaaagatgtcctgtaagatcaagaccgattggtgtgaatactgaagggggtcttccacttgttaatgacccagaaacattcctgccgacttccagccttctctcatttcctccatttttctcttcctctgttctgtgcatgaactggcacatcactacttagagcagaagatatgctgggcttctgatgatggctgcactgcatggtagggaattttaaccagtctctttgcatggtgcttcccaacttgaagtgttagcagaaacgtgcgttgttcttttggattgccgcgtagctgcagcgacagacttgggaggatttaattctttgcctcgttggttagtctgtttgtcttcagaaatgggtaggtcctaaatgttcagactgcttagtattgtgccaggtggataactgatttctcctgctctctcggttcttttttctcccttcatctctcatggtgatgctgcatcctctgtagctgtaaaatgcagacccattctttgcttaaacaaaggcaccaaattaacaagtatggggagaaaatcatgcaagattttcttatcaagttctaatgtgatctgactagatttgtatttttaccagtctttattttagtgtgtatcttggcttgttttaaatagaagaattttgccccctgcatctctctgttgggtgcaaacatggagatgaaatatttgatttgcaggattccttcctcgctgccccagggtagaggagaacgtgcgaccctccccccactctgtcctctattagagaatcctggggttgagttccatggctggcagttaccattggaaacccattcattcataatgcatgactcgaccctccgaattctgaatgccattgagggccagcaaacaaacatgtaggagataatttgctttttttctgacaattttttttcctgtctttgaagtacagtcaaatctgggtggagctcaatgatagcattacacagggaaaagaaaaaaagaaaaaaaaaaacccttgggttttgggttggtccttaggtttgcttcctgaaacagtggggattatttttgtgtcagagctttttctacaagtatgccccaccctgacattattccttcttttggggggataggagagcaagtagcaaggcagtttgttttaaattaaaaattgaatgttaataaatggatttctgaaccaaaagataaaatggtattattgtcttaaggaaaagacagtttcaatgtaatagctttcaaaatgaggtgtttaaaagattgtttctctggcttagatcatgttacagcagttttattccttatgaaaatttgttttaaaagaaggttttaaactccagtttatatgtaaggagagccatttgttcatgcagaattcttcaaatgacgtcttagtgttaggattcagttctgcctagtgtgaatctgttttctggtgtctttcattatttcaggcagaggcttgagccccactgttcctaacccactataatgttaaataatgcacgcccctcccaagcagcacacaatgagaagtttcatgtgtgctgtggtatgagaaagcagctttcggatgcagagacaggagtagtaacccttcctaaacctttaagtgtttctgtccaattttctcctaggaagacacaagtgatttgcattggaaaggttaaaacacagctgaatgtaaaaattttctctgatagaacgtgctgtttcaagatatatgaatgcagcatatataacccacacattttttaaaagaagactaaaatctatacacgttttttccataggtaatactatagtcctgcaatgacttaatttttttttattataacaaaagcttcatggattttgttgcttgtgaaataaagttaaaacattcattctttgtcttactaagaaatgaaaatgttctttatctgggtatccttaggcgttaatttctccatacttagggctttcttttatctctttttattaggtaggggaaaatcccaaatatgtagcaatttctaagactcccttgtgcctcttttaattatttctcttataaaactaaaactacccaaatatttgaggtattattgaaatgtgtagaagagaaatacttttgaattttaaaaaatgtgctgccaaattatttactgtcatagttttttcttcaaaaaatatgacttcaattactttttactatggcaaaatgatgatttgcacatacctgtgatagcctttttctttaatctctggtgccatctctgtccctttattacttatataaaggctgtagttcagagtagaatttgctccattatagggttggctattagggttttctgaatattttcattgtgcagatggtctgaatttaacggattagatttcctcatagaaattggagctttagattggaccagaaagtgagaaaataatgagccaagtattcaaatagcatcactgcaggaaacagatttctgcttttagtatgcaaatgtttctattcccttctactttacctcttcggtcttcacattctcgacagcctctatttttccattaagtgctttttgttattgtctttaaacattattaatttaagtacttattctaatcaacaacagaattaaataatgtgcttcgtatataccaggagcaaacaggaggttcctattatgtagagctgtgtctcttagttctgttgtgaaataattttctcttttcccttcttgctagtttcttccaacccctagaattggtaccagcacctagtccccttgctgacctctacctttttttgtggtcccagaatacttagcctctttgtgtagtccccaagcaaagcaagggaggagacctggcaaagtgatgggtgtggagagaggagaccccgagcatcttgactgtcccagagtgctgtgagatgaatgtctattagcctgaccacttaacattccaccacacagacgcagcctaatcttaacaatcggctgccaaaggtgaggcaatggccttctttatatactaaagaaagaggtaggggaaatatgtctttatgatatatcataaagacaagtcaggggctcagcttaaaaatcagcttccatttggtaaaaaccagttcatctgaggaagctgtcatatatctgactctgaaaataaggagaaaaagaaccttggagagcttggacacaccctgcctgaagacaaaagttaaaggggatggcttctgaatgccttccccccaaaacacacacacccacccacacacccacccccccccccacacacacacacacacacacacacatcatcatcatcatcatcatgatcatcatcatcatcatcaggaaagataatgcatctagccttctgatttacaaaatggcccatctgggatagaggcttgatttaactggaaatgggtcaccctgttttaatttcactaaagattgtcctcttttcttctaattgagacctcagtaacaatgcaattcaattgcaggcaaattataataggctgaaattttaaaaattaagaatacccttttcatcatgttttaatttataccacatgttctggcaggtacagggtagcatactgtgatttatagataatccaaatggttcaggatttcctttctataaatgtaccagaagatttgtaattgcttggaaagcagatgtttgcatgtctgcatgagaacaataaaaaatgggctgggccaggcacaatgactcatgcctgtaatcccagcattttaagaggccaaggccggtggattgcttgagcccaggagttcgagaccagcctggccagtatggtgacaccctctcgctactaaaaatacaaaaatttagctggttgtggtggggtacacctgtaatcctagctatgctggaggctgaggcaggagcatcacttgaacctgggaggtggacgttgcagtaagccaagatcacaccactgtactccagcctgggagacagagggagactctgtcttagggagagaaaaaaaaaggcatcttaataaataagtccaactaaagtggcaccaaagagaagcaataacgcaggaatgccataaaattagactgtaggaatgtaattgagtacctttaggatgatgtataatcaaatatgtgacctcttacccacaaatcacatgttaaaattttgtttttcagtagaatcttggcctctgttaccctaccacattccctacaacaggcaaacaagattttgccagctccctccccttctccagaagagcgatttaactttggcttttctctgccattctttcttcctgctcttactcactgtggtgtcagcaataaagagtgtggatagttttctgatctaaatggtataatttgggatggaaaatgtggtctaaatcttagaattgtggacataggcatttttctctcatttcagcttctcctatcaagttcttttgcatttgggggttaattgccaccaaattgtaggagatttgagaaagtgagccaggaaaaacaccagagatgatgtgagggaagaaacgctggagctggatatttttatgcccaaggattttgttatgtgatcattgaattgcttttcccacaacaagctctgtttagttggcaagcccccattaataagggatttatgtgccaaccttcttaggctttttattttcatgcatatgtgtctgtaattgcccaatagttcttcttgcccagtgcacagatacagccgatttaccaagacaacagtattgcaatagagaaagagtttaataaatgcagaaccagctaagtggaagactggactttattactcaaatcagactcccccaaaattccaaggctagggtttttcaagggtagtttggtgggcagggggctagggaatggggagtgttgattgcttgggtcagggatgaaatcataggaggtcgaagctgtcttctggctgtcttcacttcctggatggaattacaaaacttgtggagccagtttactggtttgggtggtgccagctggtccatcagaatacagggtctgaaaaatatcttgaacaccaatcttaggttttacaatagtgatgttttttattttttattgtatttatttattcaataaaatccagaccctgcacaatacaatagtgatgttatctgtaggagcaattggggagggtaggaatcttgcgacctgtggctacatggctccttactgaaccataattctaaccttgtggctgatttgttagttttataaaggtagttttgatcctgagcaaggagaggcttgtttcaggaaagggctgttatcattcctgttttaaagttaaactataaactaaattgctcccaaagttagttcggcctacatctaggaataaacaaagacagcatggaggttagaagcaagatggagtcacctatgtcagattcctttcactgtcataatttttctatgccagatgtttctcactgtcataatttttgtgaaggcgctttcatgtactcaatagttctgtttctttttctgcatctatgaacatgttaaaatatgtcactaatgtttaccctctggatgatggtttatgttgctaagcattagactatcacatgggaggctgggcatggtggttcacgcctgtaatcccagcagtttgggaggctgaagcgagaggatcacttgagcccaagagtccgaaaccagctgtgcaacatagtggcaccccttctctacaaaaatacaaaaattagctgggtgtggtggtgcccacttgtggtcccagctacttgggaggctaaggtgggactctcacttaagcctcggaggtggaggttgcagtgagctgtgagcatgtcactgcactgcagcacgggtgacagagggagaccctgtctcaaaaagaaaaaaaaaaagactatcacattgggaagcaggtaatgtccaaggtcaagtgcaaacattcagatgaccggcaacaaccacactctttatcatggaattcagcaagtgctgctctttgctgctgctgtgaataagtccgtttccatgttatatttcgctagtttgattcattcaaaagataatgtctactatgtaccaggacacttctaggtgctggaactactgcagtgaataatcagatgcaaatctgtgcccttgtaggccttacattctagggggagggcggagacaatatccaaaatatataaattacatagtatgtcggaaggcttagttccagctgctataacaaaaatgccatggattggatgacttaaacaaaaagaatgtattgtctcacagttctagaggttaggaaatctgagatcagggtgcccccatggtgggttctagtgaggccctcttctggctttataggcagatggcccacatggcagagagcagacagagtgggaaagcagtctccctcttatctcctcttacaggggcactaatcccatcataagggctctaccctcatgacctaatcacctcccaaaggcctcacctcctgatcccatcacattgggggttagggcttcaacatatgaatttgggagggacacagacatggagtctataacaggaggtgacccgtgctacggagaaaaacctagcaaggactggggatagcagtgctaggtaactggtggcaatatgcaattttgaacagaatggtcagattgagcaggtgacactgagctggacaaaggggagtgagcttctttgtaagaggtcttgctgtttgttttccacagacagggaacctcagctagtcttccatatgaaaactctttttggctaaggtcaatatcaaactaatgttgaccatttgtattattttaaagtggttctttctgcgtttgctaccatttcctttctactggctttttgtcaatgtgtctgatgttagttcctacatccaaaagcattcgagcttctttacaggcgaagtccaccccaggcatgttttcacacggatcccttcagaagttagttttgcagctctccagcatatagaagagcagttctatattctgatttctttcattatagtgcactgacttccactggttatgtgggtaagaagggtctctgacaatttagaaaacaagatggggaaaggagaccagcaaagcatgtatataaaacatttgttgcttttttaatcaaggagaccagaaactgtggtagtgccccaacgctttgattgaaggccgttgtatattgagtgtattcctcatgacatattcggactgattcagactttccacagtgcttattagctcattctgtgcctcagttcttctgagcacattgtcccattaggagtagtcaaatgttcttcctagtgtgggtatccagggaaggatcattatcctggcaaatctggggatctttggggattggaaaccttttgtgtcgattcttggagttctaaaaatccagatgccttcaacaggtcacttgtgacagatctgtgatactgtcatgattttaaattagtgttaaggagtaaacttaattaatttaccatgcaaattaacaatactacaatatagagacttgctctcacccactacaataattatcataaagttagaatgaaatgttttcatttttggctttagagcataaaatattggctcaagaaatttcatttagtcaacgtatatcatttgattaaaacaaatttttttcttgccaaaaatccaaaattctaaggttaaaaaaaaaaaggaataaagtccaatatgatgctttctctctgcttttttcaatacccagcatggctctgattatttcaaagggtactatgaaaaatttcaaaagctattcaaaataaaattatttttaactgatttcgacggaaaagtttttttttgttttgttttgttttttgtgtttttttttgttatttttttttttaagatggagtctcactctgttgcccaggctagaatgcagtggcatgtcttggctcactgcaagctctccctcctggattcacaccattctcctgcctcagccaccggagtagctggggctacaggcgcctgccgccacgcctgactaattttttgtatttttagtggagacagggtttcactgtgttagccaggatggtcttgatctcctgacctcatgatccacccacctcggcctcccaaagtcctgggattacatgcttgagccaccgcgcatggccagtttaacatctttttaaagaaaatatggaacacttcacaatttgcatgccattcttgctcaggggcaatattttctgtatcattcaaattttagtgctacaaaagtgagcactcatcatttttacaagttacacacacacactctagtgaagtgttaaacttacgtcatcaatttatcagataaggcagaaaacttgaaatctgacctttctgattcactgattttactgaatgaccttgggccagtcatttaaaccctcagcgttggttttgattaagacagacaagtccattcctcccctagtctgatgtcatagggatgtggttaagaaaacagacaggctctcaacattttgagcccctgagagatgagctactttagagagacactctatggaaagtctagcagataatggtggctgatcagacgtcatacctataccgtttaactatgcagtgagttctgtctgaatgtgacactcttgtatagcaggtgcttcacaaggttctatatgttattttattttattattttattttgagccagagtctcactctgtgagtgccccaggctggagtgcaggggcatgctaacggctcattgcagccttgacctcccgagctcaagcactcctcccacctcagcctcctgagcagctgggactatgtatgtgtgccaccatgcctggctaatttttgggtttttttttttttttttgagacggagtctgactctgtcaccaggctggagtgcagtggcgtgatctcggctcactgcaacctctgtctcccaggttcaagcgattctcctgccacagcctcctgagtagctgggactacaggtgcgcaccaccacgcccagctaatttttatatttttggtagagatggagttttaccatgtcggccaggatggtctggatctcttgacctcgtgatctgcccacctcgacctcccaaagtgctgggattacaggtgtgagccactgtgcccgaccttttttttttttttttgtatttttttgtagaaatggggattcaccatgttgcccaggctgatcttgaactgctgggctcaagtgatctgttcacccgaactcccaaagtgctgggattacaggcatgagagatgacacccagcctgttttaaaaatcatatctttaataaacttatctaaaaggtacagagttggaaaatgggtgtgtcatgtttgtaactatactcatacataaacagcagaattttctgggtttttttttttttttttttgactagtcaagtgaagcagtgggagtggagaaggagaaacaaaatctgtaactggttgtgatcggttacctgtaaacaccactgcacttggaccagccagcagccgaattttcctaataaaagttgacacgcttttttaaaatttggtgacttggtaggaaggaaaactattatttatatttggaaaagaatgttttctttagaaagtacagaagtgttgcttctgtaaatatggagtatttccaagctttaaaaacaggcaccaggccaagttaaagtgtcatatgtaaaccaagcttctgtagtgcagcctttttaaaacacaaggtcaagggcggtgttgtggtttaagtagtgaaaaggccatgggttttagagacatatactccttggatttgcattctggtaaacttcttgactgagcctctgttttgtttcttctaatctatagaataagaataatagtgtgacccctcatgcctgtaatcccagcactttgggaggctgaggcgggtggatcacgaggtcaggagatcgagaccatcctggctaacatggtgaaaccccatctctactaaaaatacaaaaaattagccgggcgtggtggcgggcccctgtagtcccagctactggggaggctgaggcagagaatgttgtgaatccgggaggcggagcttgcagtgaggcgagatcgcgccactgcactccagcctgggtgacaaagcgagactccatctcaaaaaataatagtaataataaagaataaagaataatagtatgacctcctgcctagggtcatattaaatattaaacctcttttctttccttccttccttccttctctctctttcttttccttctttatttctttcttttctttcttccctttctttctttcgtaaccacccaacaggttcacctcgcctgctgcctagatagagccaatttatcaagacaggggattgcaatggagaaagagtaattcactcagagccagctgtgcaggagaccagagttttattattactcaaaccagtctctctgagcattcgggatcggagtttttaaagataatttagcaggtaggggcaggggaagtagggagtgctgactggtcaggttggagatggaatcatagaggagtcaaagcgaggttttcttgctgccttctgttcctgggtgggatcacggaacttgttgagccagattaccggtctgggtggtgtcagctgatccactgagtgcaggctctgcaaaacatctcaagcactgatctttggttttacaatagttttgttatcgcgaagagcaatttagggaggttcagactcttgcagccagaggctgcatggcccctaaaccttaatttctaatcttgtagctaatttgttagtcctacaaagggagactggtccttaggcaagaaggggtctttttggaaaagggccattatcaatttttttcagagtcgaactataagctcaattccttcccaaggttagtttaacctatgcccgggaatgaacaaggacagcttaaaggttagaaacaagatggagtcggttaggtctgatctctttcactgccataattttctcagttacagtttttgcaaaagcagtttcactttctctctgtcttttattttctttttggtaaagagtatttccatagggaattagagggctctggacaccttaccaaatatttagaaaatgaagaggtaaattttagctcagccttggtttatgccttcggtgtagaagccaggaattctttaaggtggtaaaaggagctgtgttttgtgttgtaactttttcctctcttgtgctctcaaactctttgctgtcttctctttctgtgttgccctcttctaattctcctttcctggcatgatccctaacattttgaaaccttctctgaattaattcacttcaccaggtctttcaaatgcccagacatgaataccaacagatatttcttttaaattatagggaatacctctagcctttgtccctaccccatagcaaatatattttagtttcaaatctataaacctttagtcctgaagaaaacactctgaaccatatacaaaatctttaattaaaattctaattttcacccccatgcatattaatagcatgtaggggaggaaaaacttttcttctgccctcctagagtatgtgcctagggtctataaattaaagtgacaaaagacagattaacgggagaaaaaggcatacactttttttgatactatttttaattttacattatcaagggcttcacaacctcctctttgggttttatataccattttgacaaaggacaatatattgcggagaactgcctagacaaaagaaagaggggtttggactcctggggcagtaaattgtaggaaatgtatggtagataaggtttgtttagtaagatcattttgcaagatcatctccttgcagtcttcagtgtttaagagacttctcttcctggctctggagagagaggcacctttacaaatggaaatttcctttacaaaagagaaatttatgctctgcttttaggcagatggggaagggcagagaggtccttttctgtctgttctttctatatagctttcagctcaaaataatccttatatcaaagtgacatattttgatgtgacacagtccaacctcttcaactacgatagttggaaaaacatattcaatttcaataagaatatgaaaggtaaatatatgtttaaatatagtcatggctaaaggcataagcagacatagctatataaagtatttatccccttagttaccactgctttgaagcccagcgagcatacctctttgtacaacatgccctcttttaatttgttttgtttgcctggcgaacatgtgaggattttattgatttacaaaataaacaacagggagctgactgtacttgtacagcaataagggttggcttattggtcattttgaggtcactggcattgacttctacctttatttatttattttttattttattttttatttttttgagatggagtctcactgcactcacccaggctggagtgcagtggcgcgatctcagctcactgcaacctctgcctcctgggttcaggtgattctcctgcctcagcctcctgagtagctgaggcaacaggcgtgtgccaccacacccggctaattttttgtatttttagtagagacggggtttcactgtgttagccaggagggtctcgatctcttgacctcatgatccgcccacctcggcctcccaaagtgctgggattacaggcatgagccaccacacctggccgacttctacctttacttatagcacaatgcttatggtgaaagagccagtgattgacttgtacctacagatcattatatgtttttctgttttgattttctgtctgacagcagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtaagcctcctttgtgcttggagaagggagtttcgcaggctgacctcctacaacctactgcaggattctttcccagaattctacagttacctttgagagaaaactaatctcttgtgcttctgccagacattgaaaaacagaatcatgagttgcaaataatttactttatttcaaaccattataagcaagagaaagcaatccagtaactactgattcgtttacacaagagatggagcattaaataagaatgttaagttgaaaaatcttttaaaacttccctttgttctttgtgaaacaatttttgtccacagcagatccctacagagggtctttcagagtcaattaaaaaaatctatcatttcctcccatataacaaatcaggtaaaacatctgcatacatgagttgttacttcaaaaggtatagcttctttttcaaagattcttcagacacatactaatgtcacatttgaatgctatgatgttttagataaagaaaaaatatatattaaataaattacctgactatgtaatttgctgtatgtgaaaacagacttccttatttatcttcttcatagagtatttgtttttggagaggggcgttaatcagttatcaaaatatacttttaccccattgtttaacttaccatgtaagcaattaagcataagtttgttagtaattagtttatcttacttataaatatttccctagtaaagttatgtatctttcttaaaaataaatatggtaattgtgttttatagcattttgttaagtacatttttatcattatttaatatacatacttaaaatgctttacttcctgtgatagaactggaaatcagtatttcaaatggcttcaaatctatgctgattacacaaatatctgatttaacatgtctttattatctgattgaccattttttgagttgatttactttgcaaggttcaattgcaaaagaataaccatatccttcatggtggtgatggatagaaggagaaggtagatttgttactagtagttgtggcttttttgtttgttttgggttgttgtggggttttgtgtgtgtgcgtgtgcttgtgtatatgggttttggtttgttttagtggtggtatatagggcactttttattttattcattttatactttggcttaagtgcttggtaattcatattacaaaataattagagtgtgattcctccatccccttaatgggtgcacctaaaacatgaataccagctaatagtccatgtgtccctgggcacacatgggaagatcgttacctgatgtgcagcagtcggcatagcttggctgatactctctatagaagtgcattcagagccactcagtctgaacttggcagaattgccccatatcccagtattcagtgtccagcctatctattgtttgggtcctacttcctcactctgacaggtgagaagcaacactctggctgccctaggtctgcccctgctatcttctttggggatctagcccaacccacttccactccccacccaatagctggtggtagagatttgtgagattctgctacagcaagtccttacacaatgctctgtgttaaaattgttccagcctcatgcatgttgagatgatttcctcttctttttttattttatttttaattttgagatggagtcgcactctgttgcccaggctggagtgcagtggcgcaaactcagctcactgcaagctctgcctcccggattcacgccattctcctgcctcagcctcctgagtagctaggactacaggtgcctgccaccacgcccagctaattttttgtatttttagtagagacgaggtttcactgtgttagccagaatggtcttgatctcctgacctcatgatctgcccagctcggcctcccaaagtgctgggattacaggcgtgagccactgcgcctggccagatttcctcttcttttattttttattttattaattatttattaatttatttattttgagacaggatctcactctgtcacccagtctagagtgcagtggcacaatcacagttcactgcagcctcaatttcccaggctccagagatcttcccacctcaacttcttgagtagttgggaccacaggtgcacaccaccatgcctgactatagagacagggtttctccatgttgcccaggctggtctcaaactcctgagcgcaagcaatccaactaccttggcctcccaaagtgttgggcttacaggcgtgagccactgcgtccagccgagaagatttctgtttgaaggtgttgaaggtgctggcaactttccttaaaatggggttttttgtttgtttgtttgtttgtttgtttttgagacggagtcttgctctgtcaccaggctggagtgcagtggcgctatctcggctcaccgcaacttccgcctcctgggttaagtgattctcctgcctcagcctcccgagtagctgggactacaggcatgcgccactatgcccagctaatttttgtatttttagtagagacggggtttcgccatgttggccaggatggtctcgatctcttgacctcgtgatctgcccatgtcggcctcccaaagagcagggattacaggcatgagtcactgcgcccggtggggaaatttttgtttatgcagagacaaaactttacagcttgtctcactgtcaggagagtgagctctaggacccccatgttcagcctctgctggacattcatactggctactcagtgagcaccttacagtcactctttttttttttttttttttttttgagacagagtctcgctctgccgcccgggctggagtgccgtggcgcgatctcggctcactgcaagctccacctcccgggttcacgccattctcctgcctcagcctcccgagtagctgggactacaggcgcccgccaccacgcccggctaattttttttttttttttttttttttgtatttttagtagaaacggggtttcaccgtgttagccaggatggtctcgatctcctgccctcgtgatccacccgccttggcctcccagagtgctggcattacaggcgtgagccaccacgcccagcccttacagtcactcttatcccacatcttccaaaacagcatcaaaaggcttgaaggagagcaaagccagacatagctgctggccccttggaactcacagcctagtggaggagccagtcactaaccccctaattgctcagactaatgtgaaattaaaccagtgacaagtgctgtacaccagaagtatacaggaaacaatataatagaggaatttgccctaatctgggaaggcttccttgcagaagtgatgattacgcagaaaccccaatgatgagtaaaaattaactaaacaaaggggagtgaatagaatttcaggtatgtgcaaaggtgctatagtgggaggttgctatagtgagtgagaggtgctacagtgagagggttattcaacactgaggaagaacttaaataagtccactgtggctggtatgcagcaaatgaggggaagagacagaaagtatgtaggtgctaggccatatgagatgtgtaatccatgttgccatatatggatttttgtctttgttgtaagagcagtggaagtggaaaccatggcatggctttcatctcagatggtgtgggagggagatttaaatggctctctttgagttttgagaaggtcactctggttgcaatgtggataattgttagagggtacaaggatggttatatagcagggcatgaagagaactggagaggttagaaagatatgtaggcatttggacatgctttggtgatgggttggatatggaaaatgaaggacagtaagggagttactgttttaagaatgactcctagtttctggtttgtttaaataaatggatggaggtgctattcatcaggaatgggagaggatacagtctggggttcagataatgggtttggttttgttcatgttgagttttaggacctgcaagacatctaagaaaagatgtcaacaggtcagttaatgaggctcaaaggagatgtctgtgggaagaaatataattttgggagcctgatgcttgtagccacacctgtgatatgaatataatattccagaaagagaagaggtctcatgatgaatggaaccttgattaactcaaaactgtattgactcagaaaagacagagcagacaggagaaccatgtgagtgtggtgtcataaagtcaagggaagagaaatttttcaataaaaaggaaggtgagcagagcaataatcaagcttaatgatacttcccagaagtctagtaagataaaattgaaaaacatctgctggattcagacgtcgttaatgaccttagcaaaagctgtttcatgtctggtattggttcagggctagctacctctgtgacatagacaagatcagtgaatgtctctgatgtcaggtctattcatctgcaaaataaggggaatggggctaggttggtgtgttttgaattgtttggctaggtactggaaaaaattgtatagtctaattattgagagcttagattatggtgccaaactgcctgtgtttgaatttgtactttgtactctgctcctgaccagctaagtatcttggacaagtacgctggcctgtctctgtctgttgcatcacgtgtctcaaggaatcataacagtacctatctcataggctcattggaagtactttgaattcaatgagcagcatatgtgtgagtcattattagtgacacacttctttaactaaatgagttaagttgatacctgttgagtagagacaaggagaagagatggtgtggctctgactctgggtgtcccattcttgcttcaagcaaatatttccactttgatgtgttttttatatctcattatgattttgtacgtaagaagaattttattgctaacaaaaatatttgatgtgtttctttcaatttcaaagtccacacatttatgagcccactgctagatattgtgggccagtgcttctcaaactttaacatgtatgcaaatcacatggggagctgactcagcaggtgttcgatagggtctaagattctgcatttctaccaaatgcaccccccagggaggctgacgctgctcatccatggaccacactttgtgtgccaaggcactagaaaacactacaaaagtcaatgacattttttatttccttgagcataatcatttgcctcattagtgtgagtacagcttacctgttggtttctgaaatattattttcctagtaaaggagactgggatgggagtttctgccaaataccttgtgtagtcactgagaacatgtatggtacctgtgagaagtggaggttctgcactgtgctaagctctccacctctgcttctgcaacaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtaagtggctgggatggcagatactgcccgggagcatgactactgtggccttggggaggctttgggtacatcagagattacagattgaaacagaactccatgtggaaaaatcagtaattaaaaaagatttttaccagccctcagactacctgctcactttctttgaccagaactatttaaataacgaaatcaatctccactgtgtctccttcacacatattgttggtatccccaggacagcaaaccagtagctatttgcaagctgacctacataaacatctgtgtaataaatttatggatacggatttaacaatggataagttctgtaagttgagaatgattattaaaatgttaattagagttctttatttttcttgggagggaaattttctcatgctacattagaccttattccttattaatagatagaatttgaagctatgtgaatccctgatagtagattatagattatgaattccaaacatatttcttgctactagtgagtacaataactgttagaagctcaggaggacctgtgggtaccatcaagtaactgattcacaatagctatgtaacctgaagaggcagcattgtgtagcgtctaaggacattggctttggagtcaggctgcctgattcaaatcctgctcttaaacttattccctgtgccagctttggtaagtttattaaactctctgcgtctcatttctttatcagttaaaaaaaagtaataatagtatttaccatatagaatattggaagaattaaatgttcaagtcatgtaaatcatatagtaggatcttgataaatgtcagctttaacattttttcattaattactttatattcatctcatttgtatattggtcacttcaaaagtatttgaaactgcttaaaacaaaaggcccaggtataacaaaaccactaagacaagcaagcaatcattagagcaaagcaattcttattagccacactactgtttgtttacctcatctcccagcattctctctgcacactgtgctggagcctcaccagcctcctagaacctgccaaatggtttccctcctcggggcctggctgttctgttccttctgcctgggttgctctttgtttcctctttatgtggcgagcttattctcttccttgaagtctcactgcaaatttctcctgcacacagcagtcttctccacctgtaccgtctaacacaggttgcctcttacagctggttaccctccatcatgtccctgctttctttcctccctggtgctcactgtggtctgcttgccatcagctgtgtatttgtgtacttattagtcctggctttccctctagaatgtgagctctgggagggcaaggacctgtcattagacccctagcactgagggcagtgtcttatacatagaagtcaataaatatttgttgaacaaatttgccagacaccgtatttggctccttaaacccccctctgcaaagtagttgttggttactttcactttataagatgaagaaactgaggctgaaacagtttaagtcacaaagcttgctgggcacattgtaaaagctagccctggaagaaatagcatcctgagctttctggtagccaaaacaagagaaggacaccatggcttacacatctgtaataatttaattgaaagcacaccaggctattaatagctatcagttttccatgcattttatgccaagggaaattgatcatctaaattttgtaaaaagaacttttaaatgctgcttttgaaagcaggttgagtattttcctcatgaccacttctcacactggtgcttagtgaatgctgaggctgtctatgcctggagcttgcactctaaatactagttatgggaaggtatttctatcaggtgtaagagtgccccttaaaatgaggctctctggagacgtgacttgatagaggagtaaagtcttagaaacattaggttgttttattttttatgggttttttagtttttgtttttgtttctgagacagagtctcaatctgtcatccaggctggagtgcagtggcacgatcatggctcactgaagcctcgacctcctggcttaagcgatctttccacctcagtcctgtcctctgccccagtatctgggactacaggtgcatgccaccacgcccagctaatttttgtattttctgtagagacagggtctcactatgttgccaagactggtctcaaactcctggtcccaagtgattcacctgccttggcctcccaaagtgctgaaattacaggtatgcgccactgtgcccagccaagctaatatttctaactgtcattatttctcattctacatgacagccccttcatatcccaaatttacaccagtgtctatagtaggtctcctaatgtttctaagggccagacatggtggctcatgcctgtaatcccagcactttgggaggctgaggcaagccaatcgcttgagcccaggagtttgagacctgactgggcaacatggcgaaatcccacctctaccaaaaatacaaaaatcagctgggcatgatggggctgcacctgtagtcccagctgttcagaggctgaggtaggaggatcctgtgggtccagacattgaggcttcagtgagccatgattgcgcctctgcgctccaacccaggtgacagagcaagactctatctcaaaaaaaaaaaaaaaaattaagaaaaaaaaaataaatgttacctccataagtaaagtgagaatgtcatgaaattcaggcaacagcttatagctcaaggaagcggctagaacatggagacagcggagttgagggtgggacacaggtgggcctgaaaagatagatgtggagagattgggatgagctgtgaatatcattaagaacatgtttgacgtcaatttcttaaattgcaaaagcatcaaagccttctgaacaggagataggtattttattgacattttggaggaatggggtggcagacactaaaggctgggaaaccaattatgagtttactgaattgtccaaatgagagataagagatggaactagaatggcatcaatgggcctggggaagacagcgtgaatttcagagaaaagagtactctttgactcaacaatctgcctcccacaaataaaaaggcctgtgctaaagtctgttaagctaagctattagatcgtgagaacttcagcaactaaaattaatcttatactaggtcacaaagaaaataccactatattttcccattgtgtaaagcaagttcctgccctacaatgcactaaaattacattagtaacacatgtttatggggaaaaaacaaatctcctttaaaagttaataattatttaatcaatagaaaataatagaaataatagaaaattggactatttacaaagtattggaagtggaaactttttatatccaatgtgtagggtcaaatctctacccaggaaattttataggtttaagtattttcctttatttaaaaagaattccagcctgggcaacatagtgagtcctcatctctacaaaaaaatcaaaacatgaggccgagcacagtggctcatacctataatctcagcactttgggaggccgagacaggtggatcacctgaggtcaggagttcgagaccagcctggccaacatggtaaaactctgtctctattaaaaatacaaaaattagctgggcatggtggcacatgactgtagtcgcagctactcaggaggctgaggcaggagaattatttgaacctgggaagcagagattgcaatgagccaagattgtgccactgcactccagcttgggcaacagagtgagactctgtctcaaaaaaaaaaaaaaaaagcagggggggatagtggagcaagaggattgcttgagcccagaaggttgaggcagcaatgagctgtgatcgtgccaaagtactcctgcttgggtgataaagcgagaccctgcccctacccccacccaccccccaaaaaaagaattcaactcaagttagaaaaagagtaataaaataaacatatggaacatacacaaagaaagaaaagaacagaaatatctacacatagtatagtaagtttattaaatacatagtatatatatttctgcattgtaggaaaagctagaaaggtctcccatttcatttgtgatacgcttataaccctgataccaaaacctaatgaagatagaacaaaaagaaaatcattagtagcttaattaatgacattggctgtaaaattattaattaaaataccccagcaaattccttttttttttttttttgctgggtctcactctgtcaccaaggctagagtgcaagtggcactatctatcatggttcactgtaacctccaactccagggctcaagtgatacccctgtctcagcctccagagtagctgggactacaggaacatgctaccatgcctggctaattctttaagtttttgttgagaaaaggtcttatgttgcccaggctggttgcaaactggcctcaagggatcctcccatctggacctcccaaagtgctaggattacaggcatgagccactatgtccagcccaccagcaaattctttttttttttgagacggagtctcgctctgttgcccaggctggagtgcagcggcacgatcttggctgactacaagctctgcctcccgggttcacaccattctcctgcctcagccgcccgagtagctgggactacagatgcccgccaccaaacttggctaattttttgtgtttttagtagagatggggtttcaccatgttagccaggatggtctcgatctcctgacctcgtgatctgcccgcctcggcctcccaaagtgctgggattacaggtgtgagccaccgcgcccagcctgcaaattcttaatatgtaaaagcacttacaaattaagaaaaatatgagcatcataaaagaaaatgagcaaataactcagaaaatccacagaggatatataaatgcctaaaaatcatttatggaaaaatgtcaagcttcacagataatcagttcttttcaaattaactacaaattttttaaaaggtagtaaccagcgctcttgagagtatgtatggtgagacattttcatatgctgtgggtggaagggtaaattgctcttcagaaagtttacgtcaatttgacaaaatataatgagtgttttatacagcctctcatcttttaatccagtaattccaccagtggaaatatttctaaggaaatagctagagcggaagataaagctcaaaaattggaaataatctaaatgtgcaacattagggggcaagaatgcttggcaaattagcagcatgtgccttaaatcattctattgtttgattatagattgtagaagttcactgctgctgttttgaaacagaagtcttcattgcatattcaagccaaattcatgcaatgttccagataaattgctgcagttagttgctgtgagtagatctttaaaaacaatccaagcatctgaaggttaataaaatcaattcattaacaataaagcagggtgctgccatccccactgtctgatgctgattggcacgtgtggatgaaagcctgtcatcaactttaagtgctgtgacactatctgtcttctaattaaactgccatggtggcattgttcaaatacaaaagaaaaagaaaaataatggtcagtgatctaacaggttctttgcacttaaagcagacacttgagctcatgcctcatggtccctggaacacaaatgatcattaaaccctgttattggttgcttaggcacctgactatcaagggtgtcaaaggtgcaaaggagaggtcctcattaagactgccctgccactaacaagtttccacttccatatcaggatcaactgtcagtgcccttaagaagccaagcctcagggttggctgcaagaccttgaccatcttttttgcatgttaggaatgcataggatcctgccagtctcttctggtgaacataaatggtgactatccatcaacaacaagctcatcctagcttttggcctgcccacccaccccaggccgcaccagcatcatctcactggagatggatgaaatggatgagctcagcagaattacacgccccacacaattagctctcagcttaaaccaaagctgtcagaaccgaagcacgagcctttgaaaatgactagctattgataattcaaaatcatttcagggccttggcttcccaagacacacttaagatattgaactaggaataataagccaggtctgctgctgtctcttcaaagctgagatcaatttttgtttgtttgtttctgaagtaaaattcaggctgggcttggtggctcactttgggaggccaaggcaggaggatcacttgaggccaggagtttgagacatgcctgagcaacaaagtgagaccctttctctacaaaagtaaataaatacataaatacaagataaaaaataaaattcacatcacataaaatttaatatttcaacaattttatttgtttgtttgtttttttgttttgagacaggatctcactctgtcacccaggctagtctcaaattcctgggcttaagcaatctgcctgcctcaacttcccagagtgctgggattacaggtgttaaggcaccgagcctggcctgttttttttgtttttctttttataatgatgttttttatttttaattttttttttggagacaaaaaagtctcactctgtcacccaggctggagtgcagtggcatgatcatggctcatggcagcctcaatctcctaggctcaagtgatcctcccacttcagcctcccgagtaactgggactataggcgcatgccaccaacctagctaattttttttttaagagataggttttgctatgttgcccaggctggtctccaactcctaggctcaaaggatcctcctgcctggacctcccaaagtgctgggattacaggagtgagccactgcaccaggtctcaaccatttggaaaagcacaactaatgtggtttttagtatagtcacaaagttgag

SEQ ID NO: 523 - DNA, 4873 bp, Homo sapiens
agccattgatgtcagcatatctaacaccatcattctctataagaagaaagtcatttagctccagctggcgtgtttggtgaggagcccttcccagaataccttaggctgtggtatttgtgggcagccagccaagcagcaggtgtgttgactttaaactgacttcacacttactgaaaagaaagaagaaatgtacaaacctcctgtctcaaatcaaggggtttacctgctccctgatatgcaaagttctgcactcctggatggaataggctgaggagagagaagaaagattctctgggggttgagggtggaaaataaacagaaaggagagtgtgagtgtgtatgtgaagtatgtgtgtgtgtttgttgttctggagttttttttttttttttgagacggagtctcgctctgtcgcccaggctggagtgcagtggcgcgatctcggctcactgcaagctccgcctcccgggttcacgccattctcctgcctcagcctcccgcgtagctgggactacaggcgcccgccaccacgcctggctaatttttttgtgtgttttttagtagagacggggtttcactgtgttagccaggatggtctcgatctcctgacctcgtgatctgcccgcctcggcctcccaaagtgctgggattacaggcgtgagccaccgcgcccggcctgttctggagttttgtaaaacagcaaagccatggcattttgctcttgaggggcgcagaatttaaagtagaaagttggcacatcactgttttaagaaatgtctcttgagatcccacatcattcttatttcaaatctaagtttcctgggcaaagtgtagggaaagcagcatagcaaactctaaagaattttatctcagaaaatgagttttttaaaaagatggagtcatcctatgctttacatctcaagggctgccattagcagactacaatgtatgtgaataggccaccctgttaagtaacatgcgggttgtggcctaaggtacattcaggactcagcattcttccccttgataaacactcactgaagtggtttccccaaccttgagccactgcaacaatgggcattgcgtatacctggactagatttctttaccacccataaactcccacttccttatttagctgtctgcagcaaaggtctctgcaagagctgctttaagcaggcaaaaggacgacatgaagttgttggctgcttgctcagcttacctctgagatagacttgacaaagcggatcccatcattggctcctttcaccttggccaggcaggcacagaagtaatcccagtagtccttcttgttgcccaggagggtggccttctctttctgatcaaactgggtagggaaagggaaagggagaggaggtccaaacccactgctcttcattccggcatttaaatgataaataataacaatagcttcttaggtgccagcactgggtgaggccctttattggcattatttttatttattggcaaatcaaggtgtgttaataccctgttcatacagctgggtggaaaaccaccgaaggtgttattaacggatgagaaagaaatacaagaaaagagtcttggccatgtgcggtggctcacgctggtaatccagcactttgggaggctgaggtgggtggatcacctgaggtcaggggtccaagaccagcctggccaacatggtgaaaccccatctctactaaaaatacaaaaattagctgggtgtggtggcgggcgcctgtgatcccagctactcaagaggctgaggcaggagaatcacttgaacccaggaggcagaggtagcagtgagccaaggttgcaccactgcactccagcctgggcaacaagagtgaaactctgtctcaaagaaaaaaaaaaaaagaaaaagaaaagagtcttaagggcaatatgaagagtgttaactatgcttcgacttagggaaataagataatgaccttttatcccagttactcaacacttcagtttcaatatcgttttaatacacctacaataaatttaaataaatgtcagctctgagtcatttcaaacccaaaaccaaaatgggcttaattgaaaaaaagaaaggctcaaaaacatttttacaatgttaaagaaccagctgaaatgtcatgagagaggcaagcccttcagcacgttaggggcctttcctctagtgggcccgcatactacgtgctttggtgggatgtgacgttgcaaaataatggtgttcacaatgacacaggtatatctttctataacattttatagcattttttttctgattacagaagcaagatatgcgtatgttattaggatatctagataaaacaaaacacaaaaatagaaaaaaatttaacacctaataccactaccctaaaataacttctacagcatttctttcctgcctattttagttgcatgcatttttccacatctgcagtgttttttacatcagcactttttgggctaagcagggataagagttataccatcaatatgttaaaagaaaatatcctgggctgaccccagagattctgattcagtaggttggggtgggagccaagaatatactacaaataagctcccagaggatgctgatgctgctggtctatggactgcacattgagtagcaaagctctaaaacagaagcccatggataatctttagagggtccacacactcttagaatctgcctgcaaaaatgcgtgattgtgtgtatacatacacgaatgtctttttgggaagactctatagctttcactaaactcccaaaggggtatgtaactgtcccaaagttaagatctttgccatacagtaaccttctgacctaccttacaatgacctaaatctctaaaggatgttcttgattctcaaagccatcctaaggggcaacattgcaattccccaaaggatcacacttggaggattgagctggcactggggactgctctgaccttcaatctaaccacgagggcttactggctccttgggctttctgaaccatatcttgaatgctgatgagtcacccaagagggagaaaagagataccagtgcaaaaatcaacacattacaggcatcacttacttgcaggagatactcaagtttataagaaaatttatgcaagctggtgctgtcatccgtgatgggttcccctgcttcctgaaattctttgcttagttctgtcacagcatctttaagacaacaaataggaacatgtaaccagatagtgactaaactcagacagagaagcagaaataatccaggaagcatgaggagcaagtggtcagtgatacaaagcacctctgaaacataaaagggtatgtaagtatccatgagatataactccaagtcagggagtgttgaaatgtcctgagagctcacagatactttacaatgcttgttgactgggcacatttcttgttcacccttgtctgtccaccacccagggctagtaatttgcatatagtagctggacaacaaatgtttgctgtgtggatgaatcaattcagtccctgaatactgacttccagaaagctttacctttattctagccacatttcaggttcttcactataatcctactgctcattataggtaagcgcaggatcagaatacccagtatgtgcaaataatagtagtgacaatcacaattccaacaatgacaaccgcacctgcttctgttaactgagtgtccttgaggggctgggcctttacatgtatttttctcatttaatatggcattgagaggcagggattgccttatttcgatgaatctaagatacaattaattataatatacattacagtttcagagctgttaaaatgtcaaaaaaaaaagtacaatttagaatctatgaagtctgctatgattatccccattttgcagatgaggagtgtacagagaaatcagagcacttggccaaagatcatgggtggcaaacagcagagctggaataagaaccctggttttctcaagagctgtctaactccagagctcacctcttaacttctaagataattcacctccctgtgtagaaaagaggaaaacccacctttgactctcactcactgcctctgctgtgggacagagggactatcgagacactggatttggtttagatcctggaaaaccttttcccagcagagatggtgggatgtgcttcacaaaactatctgcttctctggcaattcttaaattcctaaaccctgctcccaagaaccatggtttgaagcagacctgtccaggactgaagccaagcctaagatggctgaaaatgtaatcaacacgacccctcaggcaaagattagcaaatggtggagacaggttcttgggactgattcttacaagtgactgttgtccactgtaccttgctagaagtgtctgcaatggctggcactgacagccagtgagccaggggcctgggagagacaaagagccttcctcctccaccctcctgcctcctcaggccaggtaaacactcgcaacctgatctgggaactcctgaaactttgaaggagtagactctggatatgaaatatgaaattttcagctctaatctctgatattctaagtaatattagctttgcaggaattactatttgattctttcaataatcttgagaagtgggtgttatcatcaaacccacctggcacatgaaggaagcaactgtgcgttggaaaggtgaagggacttgtccaacattttcgagggttaaaagagaagccagaagctgagcacacccctgcctgactccaaagtctttgaaactgctgtcaccaagaggataagtgggctgccctgcagaggagtgaaggctgtgtaccacacaaagatgcctcagttaaggacactccactctcatggtagatgc

SEQ ID NO: 524 - DNA, 2399 bp, Homo sapiens
gagtttgaggttgtagtgagctgtgatcacgccactgcactctagcctgggcgacagagcaagactctgtctctaagaaaaaaaaagaaaattacattgaattcaaagcagacttgaggggaaattagactccacctctttatcagaggatccacaaaagatcatggctgtgttttaccatttaccaccttctttctgaccagcttgagatttactaggtcatggttgttcattttagattgaccatggcttgacctaaatggtcattatgttttcctgctttttatattctttttaactgctagattatgtgcccatgcagtgaagtagtagtctttctggagcacacactgtgggtatttctttgatgataaatgtataataactaaaatagtttagcaagataaatatctgagcagtcccgtagatataggtaactgtgaattcaaggggaggacctcagaggactaaaaagattttttaaaaccgaagctatctagagaggaagagggagggatggagtttgaagtgcaccccttcaagggtgcacagagaccaagacaactgaatctgttgccaaagttttgctgtagccaaaatgtttaatagagccctggtcttgtcaagaaaagtattagaaacagtacagaaaagatgattctagtcttgtattagaccttattgtcctgaacctgaagtgaatcaaccactcaatgaagacagtcttcaggaaaaaggcattaaagtggtcaaacggatagcttatgggagcagagagggaagggataggctcctatatgaaggcagactaaagatggtgaactgttctgcatccggaaagggacatagcccatgttcccaaagccatgaaaggtttgagtcagggaaaacccttataagccaagttggtgaggaggaagcctggaacaaatggaggaagttccacctccccctgtaggtagtgggctgggacccgttattttaagaggtggtgatggtaaccttaaaaaagcagcccaattttaggtagagtcatccatgagttctgaaggagacccctaaccttctcctgtcctatgaagaactctttggaggaccagtctgagggagaaatctccctgtggtctgactcagagtggaagagccaaagctttactatgggttcaattctccaagcctgtgatttttcaccacctttttctccctatgtcaggccatttagccatcatctcgtgtcaaccaaagagatcactggagttggggagagatggggagcaaaaactgacacgttttgctgttgctgcctcttagcaactcagataaaagggtttaggtttgggcaagggaaggtagtacatggtgggagggagagttaaggtggaggctcaagatattttcataaagcagtttagcaggctgggcttagtggctcatgcctgtaatcccagcactttgggaggccaaggcaggaggattgtttgagaccaagagattgagactaggctggaaaacatagtgagacccccatctctcaaaaaaagaaaaaaaaagcagcaacagcttagcaattgtggttgtgttttgattcccacagcctccctcatttgatgctgaggcatgggtccttggatcttaatcatttggggtcgtgggtccctctgaaaagataatgtaaatgctggaccctctctccaaaacctgcacatatgcacacaacccacactttgtgtataattttggggataccagagcctttgaagcccatcccagactcccagggtaagggccctgggtaggcagcaatctcagaccgagatattgggcccagccccacttctgccaagtcatgtcatctgcatggggttgcttaatctctctgaacctgaattgtctcaacacggagtgagcctgccttcctaaggccctttccaacaccaatattctacgatggcagtgagaaggaaatatagtgtgtaagggaaggattattataaacaatcttcttgattttttttttttttaacttagagattgagaaaggttgtttctaattattgcttgactggatgaaaggtataatcaaaatatgatgctaaattagtgtgtttttcctagactatgaaattcagaggcaaatcaatgaacttgagaatggaggtgaaattctgaacgaaacacgctcatttcatcacaagctggggtgagttcgcattgctgagcgtcctgaccacagccgggggtggtgcgagagggctgggctcagccactgaccagccatgtgaccttgaaggaggcacgtagcgtctccacttttaggtttcctcattagtacaattagaaaagtactgtacccttcatgcctgtaatcccagcactttgggaggcaatgggcagatcac

SEQ ID NO: 525 - DNA, 11149 bp, Homo sapiens
tgtacaaaataaataaataaataaataaataaataaataaataaataaataaagtgatcataagagcctgggcaacatagcaagaccctcatctctacaaaagtgttttaattatctggttgtggtggcacacacctatagtcccagctacatgggaggctgaggcaagaggatcgcttgagcccaggagttcaaggctgcagtgagctatgatcactccactgcactccagcctgggagacagagtgatgtcctgtcctgaaagaaagaaaaataaaggaaagtgggcatctgagcactcatttgaaggaaatcctccggaatcgattcagaaatcctcatgaagtacccagaattccctgctttggagccagccagaccaggatgaactaaaagtgactgaacacttattatctgccaaccactttacatatattaactaattgatcctgatgccaatcctataaactaggtcctacttttattatccttttgcaggtgagaaaactgaggcacagagtgagcatctaagctgcccaagggcacacatctagccagggacagagttgggatttgtaccagctggtttggagctcaagccttccatcatcacaacagcttggagaggtaagtattattatccccgtttttatagataaggatattttgataaatgttaagagatgccacaatttgccagttgactggcattcaggctgcacctgtcacggctttcttcgtggcactgggtgttctgcatagaatagaaaaatgctttcctatcaccacccaagatcacaaactagtaaagaagagccagtatttccatcctggtctgtctgacttcaaagcaaggaattctgggtccttcatgcggattttctgaatccattccggagcgtttccttcagatgagtgctcagacgctcactttccttttttaatttttctttctttcaggacagtacatcactctgtcttccaggctggagtgcagtggagtgatcgtagctcactgcagcctcgaactcctgggctcaagcgaccctcttgcctcagctttccatgtagctgggactataggtgtgtgctagtacatccagataattaaaacatttttgtagagatgggtgtcactacgttgcccaggctcactttatttatttatttagagacaggatctcacttcatcacccaggctggagtgcagtggtgtgatcatagctcattgtagccttgacctttctggcttaagtgatcctcctgcctcaccctccctaatagctgggactacaggcacacaccaccatgcccagctaatttttacttttactttttatttttagagagataggtcttgctatgttgcccaggcttgtcttgaactcctgaactcaagcaatcctcccacattggcctctcaaagtgttgggattacaggcataagccaccatgcctggcctatttatttatttgttaatttttttaaaaaaaattgagattgcaggaaataatttttaaatttaattttagttttaaaacggagattgcaggaaacaaatatgctcacttttcaaggtccttctctggcttcctctggagactggagatcagggctgggaggtctgcacctggctaggtcacgtgtctgtcaatgcccctgtatctttaccactgcagccttgacccagtgtctcactgacactactccctgctcctctcatcctagaccacatttggtttccagaactctcacagttgggcatgttttggttgctggtaacagaaaagtcaacttaaactggtcttaacaataaagacaatttattggctcatggaaccgaagaaagtacagagagaagatggcctctgggcatggtttgttcaggactcttggtctgtttctctgattctctcaactctgccttcttctgtgtgttggttttttccttggactgtttttgccatttatggtagcaaaatggctgctgactgcaacaagactatatacttgcttttccacattcattgagcaaacatctgaactttgctctgactggatcatcttgggtcacagactcactccctgagcctgttgctgtggttacgaggacgtcactggggagagaggagaaacctccctctacccctttcctctactttgatcccagatccaagtggattcttctggaggaatgagaagagatgctgaagctggcataaggctgatgcagggacaaaatagatgttcttacagccacattgtgctgttcacatggtctgtgcagaagtcatcatgtttaaaacagagtggtaagaagatgtcacccaaagagatactacattttgccagttgactggcattcgggctgcacctgtcacagctttctttgtggcattaggagctctacatggaatggaaaaatgcttctcagcaggaacattctaggccattttaagagggcacagttataagtgggaagtgaggtatagaagataggttgggtgggctgacttgctggaacattttgaagtgggtaaaattttattctaaactcatctatatgtgctttctccctccttcagtgaaatgctcgtcctactgcgaagtgaaaggttctttccacccttgtcctccagatgcaacttctcctggagaccccagcattgctgttgccctcaccacactcatgcagcagggctgctccccttcactcctcgggctccaggagaccagcctcttccctaacccctcagtgattccttgaaatagactggaatagtgaaccgacttactgagggtttaggaaaagcagaagggaactatacaccaagaagaacttaacatacggtgttaaatatacctgctcttggccctggtctttctcaagggggtgtctcacaggggattccctgtctagcaactgctgcccccttgtggcaaaaactatccttctcccggcctcagggtctttcttgagtataggcaggtgttttgcagtctaggcccccgtcttttttctcctgtgtccccagtgactattttctgcccttggggctgattttccctagatgattaatagagggagtctcccacctcctgggactaccccatctttgactcctttctagtctaggcgttagagcacaatagtccaacatcagtaaaagcaaagcatgagtggctattgtccccttacacttcctgttaccatctatgaatgataaaagagcccaggaggaaagcacaacttagcttaaaaaataggcttgccggctgggcatggtggcttatgcctgtaatcccagtgctttgggaggcaaaggcaggaggatcactagaggctaggagttcaagataagcctgggcagtatatcaggaccctttctctacaaataaataaataactaaataaaaaataaaaataaaaatataatataaaaaaagaaagccagatgtagtggctcttgcctgtagtcccagctattcaggaggttgaggtgggaggattgcttgagcccaggcatttgaggttacactgagctatgatcacaccactgcattctagccttggcaacacagtgagagcctgtctcttaaaaaaagaaaaaaattctttccagtgcagaactgtaggaatccatggcatggtaaatttggcatttgtggtagggcaggatttatacttgcacagactggcattagctccaaacattagaggaaggttggaaagaagcaatgccaggcagaccaactgggctgtgtggaagtgaagctatcaggcataccagtgactttagtgtgtagccaaaagcaatagacactgaatcgtggtggtgacttatggtccatgaatcacaggagaaatgtctcccttcatttattccacaaccattgattgagcacctactatattccctgaaagagaacataaacatgaattgaagaaggttcttgctgtctcatggctcccaagctagaagagggctgacttgtaaatgcctcacagcagggttcatgttatatggagaagtgacgaaggtgccagaagactcaagctaggggacagccattagctgctggaggcagctaaggtgggttcccagagaagccattctccgttactgagatgggggctgcagtgaccttgaccacagctcttccattcatggactgccccagctctgtggtctctctgctaaccagccagactctgggagtggcctatgccgtcagcctcagggccatttaaaccaactggtcattggcagtgattgtgcgaaagagtggctggcggcaaaggagggtttgtgttccattcaaataccctcaaaaagcctgaaaaataagtagagattgaggccaggccttggagttgtggaaggtggagaacactgggaagccaacctccaaagaagaccaggttggaggcaaaggaggaaggggagctctcgttggcaaaccaacagggaagccaaggatatcccagtaactgctctcacatccttgatgagaatgccttgaatccgagctaggccacctcaaagaagcctgcaaaataagtagagattgagtgcctgctgttcaaacacaactcaagcgcagtcctcctcctctttcccactggattgcccccaagtccctcctatgggggactccttctgaagtctctgctgtaagtcaaatccttcgccctttatacttggtcaggaagttgcaagcttccacaggtgatatactagggaatttaggaataaacaaatggaaataaattcaagaaaaggaaaataataaaaatgatcatccatagagtggagaattcagataatggaccctcaaccccagcttcacacctgggacccccacttggtcatatggaccctggcagtctctaatcacaagtctgtgatcccttgacttaaactgttcttccccaaatgtagacatgggtggggctcagaagggaggtgtcatctgatgtggtttccttatttccgtttattcatcaagtgccctctagctgttaagtcactctgatctctgactgcagctcctactgttggacacacctggccggtgcttcaggtaggaagccacctctgtttgctaggactttctgtggggtagggctgcttggcttgactttattttggaaaatgtattcatttctgtgggagctgaggatttctgctgcccgcttcctctcttgtgaccaccactcatacatggagttagcaggtgaagaggacagcctcctcatcccctctttttataccttgcccttttgtgggaagaggctgaccattccccaatttgatgtttattgcttcaccttaagactttgtcttcagtgaaaatgcaaatactggtagggagggaacacactaaaatgtgtggatctgagtggactcatcatacaccctcaggcctggcagcaaatgagaggtggatgattctgtcttcctcgatttgcagatgagaagactgaaatctataggggtacgagaccccactcaaggtcatgagacttatttatttatttatttatttattttgagatggagtctcactctgtcgcctaggctgtagtactgtggcacgatctcggctcactgcaacctccatttcccgggttcaagtgattctcctgcctcagcctcctgagtagttgggattacaggtgcacgccaccacacccagctaatttttttgtatttttagtagagacggggtttcatcattttggtcaggctggtctcgaactcctgacttcatgatctgcctgccttggcctcccaaagggctgggattacacacgaaacttattaatggtagaatcaggatggaatgaagactggatgctaggtgtctttacaaccaacctcggtgactttccaaaggctttcagacttctctggagagtcctggagctttgaggggctctttaggggccatctgggttcggagattagcacactctgccccacagtggctcagcttttatctgcttcacatactgggcttctgggaagatcttatttcagtaaactatttcacaataggaaatatatttgaaaactcttgaatgattctgtggattttttcaggggtggagggtttcagggaccaagatggagactttatcttctcaaatacttaaaactcctttagacagaggaacaaaatatgtgctcctcatttaaagaaggcttaaaatatacagtttaatgcaatgtgttgttatcacttccttcccccagtagattttaaggagggtaaacaagaatcagggagaacataggaatagaaatagtagaaggggacacctgggaacaggtttgccttcttgcattttgcttaatgctggcccttccctgaatgtctaagaccaacctggtccccacatccaaatgcacagacacagctgaggatggagaaggctaaagagggacagaggtagagacataggctgagaggaggcagttgtaggttgagctagggctaaggtgttttccccatattccatcttaccccacactcaggccaggccttagagttgtggaaggtggagaacactgggaagccaacctccgaagaagaccaggttggagtcaaaggaggaaggagagctctcattgccaaaccaacagggaagccaaggatatcccagtaactgctctcacatcattgatgagaatgccttgaatccgagctactaaatcacatttccttccttctaaccttccagttagatcaaaccattgctgaaactgaagaggacatgtcaaatattacagatccacagatgtgggattttgatgatctaaatttcactggcatgccacctgcagatgaagattacagcccctgtatgctagaaactgagacactcaacaagtatgttgtgatcatcgcctatgccctagtgttcctgctgagcctgctgggaaactccctggtgatgctggtcatcttatacagcagggtcggccgctccgtcactgatgtctacctgctgaacctggccttggccgacctactctttgccctgaccttgcccatctgggccgcctccaaggtgaatggctggatttttggcacattcctgtgcaaggtggtctcactcctgaaggaagtcaacttctacagtggcatcctgctgttggcctgcatcagtgtggaccgttacctggccattgtccatgccacacgcacactgacccagaagcgtcacttggtcaagtttgtttgtcttggctgctggggactgtctatgaatctgtccctgcccttcttccttttccgccaggcttaccatccaaacaattccagtccagtttgctatgaggtcctgggaaatgacacagcaaaatggcggatggtgttgcggatcctgcctcacacctttggcttcatcgtgccgctgtttgtcatgctgttctgctatggattcaccctgcgtacactgtttaaggcccacatggggcagaagcaccgagccatgagggtcatctttgctgtcgtcctcatcttcctgctttgctggctgccctacaacctggtcctgctggcagacaccctcatgaggacccaggtgatccaggagagctgtgagcgccgcaacaacatcggccgggccctggatgccactgagattctgggatttctccatagctgcctcaaccccatcatctacgccttcatcggccaaaattttcgccatggattcctcaagatcctggctatgcatggcctggtcagcaaggagttcttggcacgtcatcgtgttacctcctacacttcttcgtctgtcaatgtctcttccaacctctgaaaaccatcgatgaaggaatatctcttctcagaaggaaagaataaccaacaccctgaggttgtgtgtggaaggtgatctggctctggacaggcactatctgggttttggggggacgctataggatgtggggaagttaggaactggtgtcttcaggggccacaccaaccttctgaggagctgttgaggtacctccaaggaccggcctttgcacctccatggaaacgaagcaccatcattcccgttgaacgtcacatctttaacccactaactggctaattagcatggccacatctgagccccgaatctgacattagatgagagaacagggctgaagctgtgtcctcatgagggctggatgctctcgttgaccctcacaggagcatctcctcaactctgagtgttaagcgttgagccaccaagctggtggctctgtgtgctctgatccgagctcaggggggtggttttcccatctcaggtgtgttgcagtgtctgctggagacattgaggcaggcactgccaaaacatcaacctgccagctggccttgtgaggagctggaaacacatgttccccttgggggtggtggatgaacaaagagaaagagggtttggaagccagatctatgccacaagaaccccctttacccccatgaccaacatcgcagacacatgtgctggccacctgctgagccccaagtggaacgagacaagcagcccttagcccttcccctctgcagcttccaggctggcgtgcagcatcagcatccctagaaagccatgtgcagccaccagtccattgggcaggcagatgttcctaataaagcttctgttccgtgcttgtccctgtggaagtatcttggttgtgacagagtcaagggtgtgtgcagcattgttggctgttcctgcagtagaatgggggcagcacctcctaagaaggcacctctctgggttgaagggcagtgttccctggggctttaactcctgctagaacagtctcttgaggcacagaaactcctgttcatgcccatacccctggccaaggaagatccctttgtccacaagtaaaaggaaatgctcctccagggagtctcagcttcaccctgaggtgagcatcatcttctgggttaggccttgcctaggcatagccctgcctcaagctatgtgagctcaccagtccctccccaaatgctttccatgagttgcagttttttcctagtctgttttccctccttggagacagggccctgtcggtttattcactgtatgtccttggtgcctggagcctactaaatgctcaataaataatgatcacaggaatgaatgcatgctgaaaagaccactcttttgcacaccatctgctcaaagctcctcttgtctgtcctctccgctttcagcctccgtctgtccacttattaagtttgcctttgtggtttagcttcattagatgtttatctgtgtaaaaatgtcccaagtgaggacttaagatgtcagggctcttctgatggcaaatgatagaaagagaagtcaaactagcttaagcaaaactgagagtgtgggtttagcctgtgtggggaaggatcagggaaggcttgaggttgggaatagggtgaggctcagagacaggacctagatcaagcttcagatggggatcagtgattgatgttgaaatcaaagctgggatgggggcagggatggggtggcagcttgggatgaggtcagagaaggatgaatgccaggaatcggtagagatctacaaggagggagagtgagagtcagggtcacagtgaggtgttgggaacagggagattcaacatggagctgggaccagatatggagagtgagactttggaatgggataagtgtgggggagtggtgaggctcagggagggggtgtcaggcctggaatgaatatcagggaaggcttagtagctataaggctggagcagaagacgtgcctggtagggtcaccatcctatctggagcatcatctaagatcctcttccggggccaaaagacagaggctcctcagtctgtcctgcttaagactctccaggcaggtgagtgaggagggagttaggcactcgagccctaagagatagacctgattcagcagagaagacaagaaggatgcaaaggatgcacagagaatctagggcagaaggctgagaactggggcctccttttcctctcctccctccgctgatctccctccacctctcctactgtttcctcaaagtccaacttcctccttcttcaccttatgctcctgcaaggacaactccatcagaggcttcagtaagtaaatagggatccacactgggtccaggggaaatgcaaatgactcataacctcatgaaaaatgctcagtctcactaggaactaaatgaggctcaaacagcaacaaaataactcagaagtgttttaaacaggggagggatatagtggactcttcaaacaagtgcaacatttttcgattggattttttttttttttttaatgagacagggtcttgctctgtcacccaggctggagtgcagtggtgcatacacagctcactgcagcctcaaccttctgagttcaggtgatcctccaacctcagtttccagagtagctgggaccagagctgtgcgccattatgcccagataatttttaaaattttttgtagatatggagtcttgccacgttgcccaggctggtcttggacccctgagctcaagtgatctgcctgcttcggcctcctaaagtgctgggattacaggtgtgagccactgcacccaggctgattggaaattctaatgcagcctgtaattttctgggtatagctcaagacacaaatgatttggatttcagatttttaaaaaatgtcaggattttggtacttagttaacagcatattgaagtaccaaaaactgatatttcaattactagatagggtgaggattagatccagtcagagccagggagagtgtttgccttaaggagggactcccttgtccaggatggggctggcactagggatggggtgaatcttaggacaggagtgggggtcagaaatgggaggggtcagtgatgagattgggattacagaggggatgtacatcagggtaaggtgagggacggggattaggatgtaacggcatgttctgcacaatgcttcctgatgttaaaatcctaaagtttgttttgtagccttggtgacaacgtttgagactctaaatcaaaatgtgaaaatctactgttttcccctaaaccagttccacttctgaccaaccacagcctctcaccaccccttgccctccatcccctggcccattct

SEQ ID NO: 526 - DNA, 11230 bp, Homo sapiens
acattcagagacagaaggtggatagacaaatctccaccttcagactggtaggctcctccagaagccatcagacaggaagatgtgaaaatccccagcactcatcccagaatcactaagtggcacctgtcctgggccaaagtcccaggacagacctcattgttcctctgtgggaatacctccccaggagggcatcctggatttcccccttgcaacccaggtcagaagtttcatcgtcaaggttgtttcatcttttttttcctgtctaacagctctgactaccacccaaccttgaggcacagtgaagacatcggtggccactccaataacagcaggtaggtgacttgttcagtctgagatgctggcaacatatttctaatggaagagatctggaaacttcagcctcctctgaggcccctgagaactggggtgatgaagtgtagaagcttagagctaaagacaactaagtcttcacctagacagtgttgcacaaaagaattttctgcaataatagaaatgtcctagacctgccctgcccagtatggtagccactagtcacacgtggccacggagcacttgaaatgtgactagtgtgactgcggatctcaatttttatttcattttattttattttattttttcttttttgagacaggctctcactccaatgcccaggctggagtgctgtggcatgatcttggctcattgcaacctcaacctacaggtctaggtgattctcccacctcagcctcccaagtagctgcagctacaggcatgtgccgctacactcagctaattttttgggttttgtttgtttgtttgttttgtttttgtttttgtaaagacagggtttcgtcatgttgcccaggctgatctcaaactcctgggctcaagcgatccgcccacctcggcctcccaaagtgctgggattacaggcatgggccaccttgcctggcctttattttaattaattttaatttaaatagctacacatggctagtagctagcatgctgaacagaatagaattagaagaagctcccgttttccaaaggcacacaacaaggcccagaaagaatgacttctccaagcaggattagaagccaggtttttgttttgtttttgtttgagacagggttttgctctgtcgcccaggctggaatgcaatggcacaatctcggctcactgcaacttctgcctcccgagttcaagcaattcttatgcctcagcctctggagtagctgggattacaggcgtgcgctgccacgcctggctaatttttgcatttttaatagaggcggggtttcaccatgttggccaggctgttctgtaactcctggcctcgagtgatccactcacctcagcctcccaaagtgctgggattacaggcatgagccaccgcaccagaagccagttttttaattcactccaccctgcatataaccgcagtgatctccatggaaatgaaattgacctaaggagcatgaagaaggaggctgactgggaaatgtcaaatctgggctcccctctctacatcctttgtatctgactttctgggacacagggaggtacctaatggagctcagaaactttaggctgggatcctgctccttattacagtgaacaggagataggatttgagagcagatttttagaagttttttaaactgaaaacctagttcagctgtgtcactctaggtatgttgcttaacctctcagagtcttcatttcctcttccagaaagtgcctgcttcgtgaggttatcctgaggattaattgatacaaattctggaaagcactttgcccagaagctagaacctggtagacactcaacattacagctaatatgacaattaatatccaggtcaaagtaaattagatgtcatcaaagtcagccttgaaagcagacccactgccgactgctttcccttgactggggatgtagtgagagaggcagcatgttatcagtgaataaactattccagtaataatgatcacaacaataaaggttaacattgtactttatgtatgttttacgtgatttacaagcaatccctcatttcatcctcaccacaaccccatgagttggattctgtattggccccattttacagatgagtaaactgagactcagaaaggaaaagtcacttgcccagaattgctcagctagccctggtgtcatctgcctctctccatatgtaataagcctctatctggttttagcatcaactggccaggtggcattgcattcttccccagcttgggaaagagaggtgacaaagactaagaaacatttgctgaacagttggactcaaagattctttctttggggtaggcaggcaatttaagtgcgtctgccacagggattgagtcccctctgggccctgggatgcatggagcaagagatagggtaaggaataatggaggggattgaggtgttgttcactggggtgggcacttgtgagacagcagaattagtgttcatggctctgcctggattaattcattcatttgtaatcaatagcaaattgataaaatacattcttagggtcacttaacattgtttttaaaaatgcatttggactttggtggaatcttcccttttaccaaaaggctttctttccaaattagagggtcttggctccaagggtggtaagctgctgcagagttggtgtcctcagacccaatgccaagtgtgcgaaacaagaaagaatatcaatacccagagatggacttgtggtcagagcagatggttggggagtgaggggaaagacaagaggcaggagtggggccaagaagtagaggcatcaggtccagggaggaacgccaccagactcaccagaagctttagtccatctctgtcattttaatgcactgctccctttgacatgtgaaagacattgaaggctatagtactgccaatggtatgatggggaagcctgaggcagctggaatgccaggagactcagacaaggcagctgaaggagccagcggctctgagatacagcaaagatgaaagaaatccatgcaatcctgggcaagccatttcctttgggcttcagtttccccatctgtaaaatggaaagactaggtagaaaacccctcaggtcccttcccaatataaactctacgagtctatgaaatgactatgcatccgagagctgatctgggaactaattattcaaagttatcaaaatcacccgcaccctcaggagctccacccctgaattgcattgagcaatctaatctaccactcacttcctccactgtgttctcaccaccacctccctttcataggtcacagctgctcttctggaggtgtcctacaggtgaaaagcccagcgacccagtaagtcttggaacacccacccttcccaccagctagaatgtctctgttctctgtttcccttgatacccagcctacatttatcctaagcatctctccccacccttggtgggcccctcaccctcaccccttggcctcttcattttctccctttggggctctccatccccaaaggaagaacttctgttcctcctccctcacaaccctctccaaccactcagggccacttgctgcccatgcttttcccttggcctggcagccttccaagactcagccagccctcctggcctgggctaggactgggtctgaggatgggccgaacactgttcgcttcccacttcccgacactaaatgcaatatttgtggattatatttatagagagaaagaatactggaactgtactaaaatgactcttttgttgttaaaaagattgccttagatgtttgagatcttgtaaatgtctctcgttctatagcattttcatgtaataaattagaattcatgccatcatctatggagtttccaaactaccatgagtcactaaggggctggcattttccctaagtcaaggaagctccctttttatcctggaatatatgactgtgtggtcagccggacccagccagttcaagggtgtttggtttatcatccctgcaagagctgtttctttcattctgggccaaagaaacggcaaaagaaaacaatgcataaaacatgaaagaatgtgagtggaccatatacaggttgatttaatgatatctcaagaacttagctttgctgggcacggtggcttacacctgtaatctcagcactttgggaggctaaggtgggcggatcacctgaggtcaggagttcgagaccagcccgaccaacatagtgaaaccccgtctctactaaaatacaaaaattggccgggtgcagtggcaggcgcctgtaatctcagctacttgggaagctgaggcaggagaatcacttgaacccgggaggtggaggttgcagtgagccgagatcacgccattgcactccagcctggcaacagagcgagactgcatcaaaaaaagaaaaaaagaaagaaaaagagaacttagcttacaaatatgtttaatagatgaggtgcactttttttaagaggaagggctatagactacaaataaggcaagtgtagtcctttatacctcactggaacagtggtttcaccacttctccaccctgtgatcgcaggctggttactgagcctccctgttaggtcagctgatcctccttgtgcctcagtcttctagaaacagggcctaattgtatctatttgtaatgagccatggagatcatgtacctgtgaggcacaaagcagacctcagatgtgtcatctccttcccttagtttgtccctctaactgccaagtcatcctctgtagagattggtaaactaaaaaacaacaccaacaacaaacacccctctccctaccctaggagctggaggtcactggcctgacctggttctccttgctgagttctctaccttctgtcctgacttgcatgctctccctctggaacctgaagctgacccataatgcctgggagcatgagctcacccatacacctccagcccacccccagcacagctgagcactggattatccacagtgaggatttacctgtgaaacatgctctgccactgctgcctgtgctgacatggcagtttctgcagcagcctcagtcctggcttctcacagccaatattcatacatacaaggccctgctctctaagagcacaagctctctgcacccaatatgccctacatctactctcaaagatgggtcttctgttgggtcatttgttcccttaagagcatctgtaatcatctgctcccagaagtgatccacccttgacctcttgacttcattggacataccctgggcctctcagcaaacttgctctcaaccatgggactgaggagctggtgacttctttcaggtcttgctgaccatactggtccagcaagctgtattcccagccctctcaatacctccccagccttctggccaggcagggccagaaatgagggattgcttataaattacgtaagacatacataaagtacaatgttaacttttttttttttttttttgagacggagtctcctctgtcgcccaggctggagtgcagtggcgccatctcggctcactgcaagcttcgcttcccgggttcacaccgttctcctgcctcagcctcccgagtagctgggaccacaggcgcccgccaccacgcccagctaattttttgtatttttagtagagacggggtttcactgcattagccaggatggtctcgatctcctgacctcatgatccgcccatctcggcctcccaaagtgctgggagccaccacgcccggcccaaatgttaacttttattgttgtgatctagtatagtacattacaactgattgaatcttctccatcagttgcctcggcatgctgggaaggcaatgtatctggcccctaactcttaaaagagaaactaaaaacttgtcaggaaggtgatggctaagaattccatcactcttgggggaaaagtggcattatttttccagttttgcttaatcttcttcagctttcttctttgctacatatgattgatgacaacagagacttcctttctgctaaaaagaaatcctccctgggacttttgttgttatttttgtaatatttgtatttgctttgcaaggccgtgtaccctttgattaatcttttttttaattaagacataagtcacataccccaaaagtcacccatttaaagtttttagcatattctacaaccattgccactaattccagaacacttttatcactcaaaagaaaaactccgtagtcattaacattcctctcccagctccccttgaccctggaaaccaccaatctactttctgtctctaccaattctacccatttgcctattttggtcatttcacatatatggaatcacacaataagaaaacttttgtgtctgccttttttcacctagactaacattttcaaggttcatccatgttgtattgtgtatcagtacctcattccttctcatggctgaataatattctgttgtacataatacagtcataagttgcttaacaatgcggatgcattctgagaaatatgtcatgtgaacatggtagagtatacgatgctatagcctactacacacatgggctatatggtagagtactgctcctaggctacaaacctactcagcatgttactgtactaaatactgtaggtaattataacacaatggtattcttatatataaacataggaaaagaacactaaaaatacagtattataatcttatgggaccactgtggtatttgtgatgtgtcattgaccaaaaagtctttcagttgctcatgactgttcctcaatttgtctgtccgttcatcagttgatggatatttggtttgtttccactttttggccttaatgatgaatgctactatgaacattagctttcaattctcttgggtgtatacctaggttggggtttgctggttcatgtggtaactctatgtttaacttttttgagcaactgctaagctgttttccaaagcagctgcaccatcttacattcccacctgcaatgtgggagagttctgacttttccacttcctcacccacattgttcttgggcatctttttctgagtgtgcccagcctggtgagtgtgaagtgggttctgggacctttaacttcctggtttttctctcacactgggttccattttgggggtagattacggacttggacatggttggtggtagggtggtcatcccttactctaaggcaatggccggagggtgatctattttgtggttcagaaagaagctaattagggagctggattgctttagttgactgctttgagaaactgggatttttttttttttttttttttttttttgaggcagagtctcgctctgttgcccaggctggagtgcagtgatgtgatttcggctcactgcaacctccacctcctgggttcaagcaattcttgtgcctcagcctcccaagtagctgggattacaggtgcacgtcaccatacctggctaatttttgtattattagtagagacagtgtttcaccatgttagccaggctgctctcaaactcctgacctcaagtgatctgccacctcagcctcccaaagtgctgggattacaggtgtgagccaccactgggataatatttttgaataactgcagcccaccctccacacccaggcttccccagagcaggatctgtgctgtccctgtggcaagggcagagccccaggagctagactaaatctgagaggaacaggggagtcaaggctagatggaggcacacacatgcaggacaggaagggtctccagcagggctggaaagccaccaagcaagggtagtgcaaaccctgtcttctctgcttcctgctgcccctctcttattgggtagcagactggctgtgtctgcttatcccgcatggtggcacatggctgcccagagctccccaaataacctgttacgtttccacccacagggagaatcaggcagcccgcttgcttattgtttttaatatacttttccaaactacacagacattcccaaagcgggtctccttctacccaaaagagaaacgctgggccttactaattaactgaagactctgctagctcgagccttccaaaactccatgccacaattgttcaaaccattttccagaatacatcttttaaaataacttttagaaaattgaacaaagggattcatgtctcagctttatagtcaaaccatgatcttttctgagggtatagcccatttggagttcctgcttaatcccctgattaaaaactgaatggggctgagtgcagtggctcatgcctatattcccagcactttgggagacagaggcaggagaattacttaaggtcaggagtttaagaccatcctgagcaacataacaagtccccatctctaagacaaaaaaaaaagaactgagtgacatctcacatctcacatttctgaacattaaacccagccttgatagccaaagatgctcgccactgaaggatccaggtagtattgagggttctgtggggattatccaaagagaactttctacaaagttttaggtgatggcgatgctaaaagaaatgctaagaatttctctcttatattaaagagaactatggtcctctcataaaatgtaccatttatcaccaaatttatctcataacctaagagctaccacttacaaatttgaagggaaaaattactacattgtaatactcaagccaacacaaagaatcctatcccagtttcttgagtggatgggcaagaatatggggaatttattatgcagtaaccttcatctctcttctataggtcaggatttaagtttacctcaaaaatggaagattttaacatggagagtgacagctttgaagatttctggaaaggtgaagatcttagtaattacagttacagctctaccctgcccccttttctactagatgccgccccatgtgaaccagaatccctggaaatcaacaagtattttgtggtcattatctatgccctggtattcctgctgagcctgctgggaaactccctcgtgatgctggtcatcttatacagcagggtcggccgctccgtcactgatgtctacctgctgaacctagccttggccgacctactctttgccctgaccttgcccatctgggccgcctccaaggtgaatggctggatttttggcacattcctgtgcaaggtggtctcactcctgaaggaagtcaacttctatagtggcatcctgctactggcctgcatcagtgtggaccgttacctggccattgtccatgccacacgcacactgacccagaagcgctacttggtcaaattcatatgtctcagcatctggggtctgtccttgctcctggccctgcctgtcttacttttccgaaggaccgtctactcatccaatgttagcccagcctgctatgaggacatgggcaacaatacagcaaactggcggatgctgttacggatcctgccccagtcctttggcttcatcgtgccactgctgatcatgctgttctgctacggattcaccctgcgtacgctgtttaaggcccacatggggcagaagcaccgggccatgcgggtcatctttgctgtcgtcctcatcttcctgctctgctggctgccctacaacctggtcctgctggcagacaccctcatgaggacccaggtgatccaggagacctgtgagcgccgcaatcacatcgaccgggctctggatgccaccgagattctgggcatccttcacagctgcctcaaccccctcatctacgccttcattggccagaagtttcgccatggactcctcaagattctagctatacatggcttgatcagcaaggactccctgcccaaagacagcaggccttcctttgttggctcttcttcagggcacacttccactactctctaagacctcctgcctaagtgcagccccgtggggttcctcccttctcttcacagtcacattccaagcctcatgtccactggttcttcttggtctcagtgtcaatgcagcccccattgtggtcacaggaagtagaggaggccacgttcttactagtttcccttgcatggtttagaaagcttgccctggtgcctcaccccttgccataattactatgtcatttgctggagctctgcccatcctgcccctgagcccatggcactctatgttctaagaagtgaaaatctacactccagtgagacagctctgcatactcattaggatggctagtatcaaaagaaagaaaatcaggctggccaacggggtgaaaccctgtctctactaaaaatacaaaaaaaaaaaaaaattagccgggcgtggtggtgagtgcctgtaatcacagctacttgggaggctgagatgggagaatcacttgaacccgggaggcagaggttgcagtgagccgagattgtgcccctgcactccagcctgagcgacagtgagactctgtctcagtccatgaagatgtagaggagaaactggaactctcgagcgttgctgggggggattgtaaaatggtgtgaccactgcagaagacagtatggcagctttcctcaaaacttcagacatagaattaacacatgatcctgcaattccacttataggaattgacccacaagaaatgaaagcagggacttgaacccatatttgtacaccaatattcatagcagcttattcacaagacccaaaaggcagaagcaacccaaatgttcatcaatgaatgaatgaatggctaagcaaaatgtgatatgtacctaacgaagtatccttcagcctgaaagaggaatgaagtactcatacatgttacaacacggacgaaccttgaaaactttatgctaagtgaaataagccagacatcaacagataaatagtttatgattccacctacatgaggtactgagagtgaacaaatttacagagacagaaagcagaacagtgattaccagggactgaggggaggggagcatgggaagtgacggtttaatgggcacagggtttatgtttaggatgttgaaaaagttctgcagataaacagtagtgatagttgtaccgcaatgtgacttaatgccactaaattgacacttaaaaatggtttaaatggtcaattttgttatgtatattttatatcaatttaaaaaaaaacctgagccccaaaaggtattttaatcaccaaggctgattaaaccaaggctagaaccacctgcctatattttttgttaaatgatttcattcaatatcttttttttaataaaccatttttacttgggtgttta

SEQ ID NO: 527 - DNA, 63336 bp, Homo sapiens
agaccggcgcgtgaggaacctaccggtaccggccgcgcgctggtagtcgccggtgtggctgcacctcaccaatcccgtgcgccgcggctgggccgtcggagagtgcgtgtgcttctctcctgcacgcggtgcttgggctcggccaggcggggtccgccgccagggtttgaggatgggggagtagctacaggaagcgaccccgcgatggcaaggtgggcatgggcccggggctagggctttgctggagccggtggtggcctgggccctccggtcagggaggggcggaatggctgagcgcctgaacctcccttcctgtgcgctcttaagacctggatattgtgttctcgctccccaccttcctcctccctgttattcacaccacccttcctctgcccagcgattccctctcagttacttacactttctccctaagtccgacctgagacttcagacaccagcaacacttaacagccctgttcccccgtgtcttcatctttacccctctcccctctcccactctgcagtgatggcaatgcgaaagcttgcgccttgcatttacctggcgcttccacctgcccggtagctcgggccacgggcagttcggccacacccacgctgagaacaacccctgggcgagaaacatcttatcccaaagtgttgattgagactatgccctctctttttctgatggttgttttcttgtttggatacttgttaatctctacatcattatatttttcaaaggtatatttttgtggaatgaaaaggaagtattagaaatgagctgaagaccattcacaggtaaagagaaaaatttttaaatatacatttaggattaaatgaaaaacagaaatgaggtgcgaggagcgttagatttttcaaagcattacgatctctttggaactaaaatatagtggttgaaatgtgatatgatgaagtaatgattgtttttgccctgcagagagtatgtctaaataaccgattcccttctctttttgtgttttgtttctacttacaccaaacatgaactttgcaataaaattacactggtaacttacaattgtttttctactatttttaaaaaatggcctctacttaaattcagtataagcaccttctgaggaaactccgggaagaagatcgactgctgtgtagattgtctattataacaatatatttcactgtcatttctggtagggttatatgagaagtaaaaaaccctatgtttccttctagtccctcccaaggacatttcctacaagtgaattctgctgaaaatgaaaattagacagctttaggaggtaaagaagtagctaaaaggaagaggtattacaggcaacgctataactgggtagaaagaggaagcacctgtagctcattgccacctttgtgttctgatgctcgtcagaggtcttttctcagtgtataaattgctgagggtgtgtgtgcaagctacttactaccactcatgaccttttttctgctatcttcagtgatttcacaaatctagctacatggatgtagaaagagtgaaaaatagaacctggggcattcacactgatttgccatttaatggagattgtattgctgaccatgttctgtgataaataaattgtgctattattgtttagttcaaaatgtattttaactgcctgcttttctttcttagattaatatttttggggacagatttgtgatgcttgattcacccttgaagtaatgtagacagaagttctcaaatttgcatattacatcaactggaaccagcagtgaatcttaatgttcacttaaatcagaacttgcataagaaagagaatgggagtctggttaaataaagatgactatatcagagacttgaaaaggatcattctctgttttctgatagtgtatatggccattttagtgggcacagatcaggatttttacagtttacttggagtgtccaaaactgcaagcagtagagaaataagacaagctttcaagaaattggcattgaagttacatcctgataaaaacccggtaggtaaacgtttgtttttaaaaatatttgattatatttttggtacattttgatatttatttaaattgctttaaatgatcaaatgcttaagaataatcatatgtcaaaattataattcaacttgtatgctagaaacaaaagcaccaaaatgttctggattatttaggatcccgtgaaggaatgtcagtaccaaaaattcagttccctcttaatttgtagacgattttccaacaattctattaaagacattaaccccaaaacaaacgataatatccgtgaagtagttgaagtagttttcttattaaagtaggttaagatcaagtgttttagaacaggaacaaaaatatttttttaaaactcagagggtatgacttgctaaaaatagaagtaatagctaataatagcatgttttaactttgactgttttcttctgtgtatgcacaagtccacaaaccagagttagaaagttttataaattaatacttcacagcagctgaatataatgccagtcataaatatttatgtacacattaatgtaaatctttcaaaactaaactcattttaatttttatggtgtttttgtaatttatttgattatttcttagtgagatttagcgttcatcattaacaagaagacatagttataattttctcttttctaggtagaagttttaaaataggattattttcattgcataaagctgagcaagagaaacaatatttctttaaatattgtttagttgattatcttttcctaagatccacattctatttaaggtttttatttttttttaatttttctttaaaatttcaaataatgatttttaagtttccatataaaagacagtagaccttctaccatccgagtattatttaaatgaaagcatccttcagaaacaaattttatgaagcacagtaacaaggaagaaacatttccgatccaattttggattgttttctttttttttttttttttttttttgagatagggtctcactctcttgcccagactggagtgcagtgacgccagcggcttcctgcaacttctgcatcacaggcttaagcaattcccctgcctcaccctcctgagtagctgggattacaggcgtgcgtcactactgcccagctagtttttgtgtttttagtagaaacggggcttcaccatgttggccaggctggtctcgatctcctgacctcaaatgatccaccctcctcagtctcccaaagtactgggatcgattttggggtgttttctgatactggcttttatgtaattagctgatagattggggcacatccttttttaattaagttgattttacctcaaatagaaaaataacctacaaatgtattgatttataattgttataggagtaaaaaatatttatgaaattaagagtttcaacaggcttattattttcagctgcattttttaggaagaataactcatggtctgataacgtctgtcaaccttttgaagagtcaattatttcattacttttcttacttttttttttttttttttgaagattatagtttcttaaaaaatacttcatttcaacccatggtaactcatgtcatgttgtattacccctccttatgttggtatatggtctcccagaagttactagattaattaaacctacatatatgttttgaagaaacttggattgtgtatctgaaataattgtattatatctaatattttttaacagaataacccaaatgcacatggcgattttttaaaaataaatagagcatatgaagtactcaaagatgaagatctacggaaaaagtatgacaaatatggagaaaagggacttgaggataatcaaggtggccagtatgaaagctggaactattatcgttatgattttggtaaggtgatacgatattacttatgaaatgtgttttatctgagtaaaagaaaagtgaattctgtttcaccacttagcttatatatttaagatgcgtcactttgattagctccttttaatttgctgtgggagtgaaatttaaaaggaatgtcagttggtatacagagatgatctgtacagatatgaagttgtattggttaaatcttgttaaatacttttaaaataaggattgctatttaataaaaaatatgcattcatggactgcataatgacatttcacttaacaatggattgtatgtaggacattggtcccatgaaattataataccatatttttactgtaccttttctatatttaaatacaaagatacttagcattgtgttacagttgcctatggtattcagcagtaacatgctgtacagatttgtagactaggtgtgtagtaagctatactatctaggtttgtgtaagtacactctgtgatgtttttgcaacaacaaaattccctaacaacacatttctcagaatgtgtcccattagtaagtgatgtatgactatatgtttgcattaggggtagctaaatatttctttcagtattttttagtattgaataatattaatttctttcaatatattttagagcatcatattgtccaagaaaggcgaaacttcaagtttagtaatgatctcttcaatagaaatgccgtccttctcatatggaacccttactgatttttaaggtgttttggccttcggttgacattaaggtcaataccttgaaacattatcaataaaggttccatatgagaaggacgaaaggtgttttttttcttaaacatggaggaaaaaataaggtggaaggaggaaacaaagtaaaggaactaaggaagagagattgtaaacacacaggtatcaagggaggaaggtgtgttcagagacccagtgtttctcctagtcattaattaacctcaaatgcaggctaagaactgaatatgcttctgtattagactaaatgaagtattttaaatttatatctggaggatttgcttttagtaaatatgattttttttcaaaatagtattttcaagtatattctctacaccttgatagtctatatcaagagttagcagactgcatttcataggccaaatctggcttgccatttgcttttataaataagttttattggaatggaattactttaatttgtttacataatatatgtgacttctttcacacttcaagagcagagttgagaagttgtgatagaagccatacatcccacaaagcctaaaaaatgtatatttactaaatatttgtgtctgcctctgcaaatactctaagctttttagcagaagatattctaacatgataccatgtgttaaaaaccatataatctgaaaatcaaatgaggtctgtagtctagttaacagtgtaccactctcaatttcctggttttcgatattgtgctatatagctacataacatgtcaccattagaggaaggtgagtaaaaagtatacaagagtctatatttttgcaccttcctgaatctgtaattatttttaaaaccataatataaattttatatggaggtaaaattatgtgaatattacgaactaccgcatacacatctatgagagtccatatcagaattctaatatctttagatcaccctaaatgtactgatagtattatttacttttttttcacttaggatgttgcatattctctaagtttgagatataatatagtagtttgatttttttgatgattaaaacgagtaatctatttttatgttgcaatttatatggtgaagttttgattttataatttttatatacttttaaaattaggtatttatgatgatgatcctgaaatcataacattggaaagaagagaatttggtaagtttgtgggcttaaggttttataaaactaatacaagttcgatctcatctaaaactctaggggatatatatgtttgaaatttagaaatcttttggagtttcgaacagtaataatgtaatatactgtatcttaaatatttctagcagaatgtggggaagtgtaccataataaaaacattaatatttatgtagcaaaatgtgtaagtatatatactaaataaaagaaatttaaaaatcagttcagatcaggtttggatgccaagtgagcttgctgcaaacttacagcaaaacttctcagagctttttgattttagagttttggataaaggtatagttattttggaagtagatttaatttgattggcaactttgtgtgaaaatggccataaaaatacagttctgcattttccattgcattttagaaaattgtataccagaatagattcttatactttcatcctttgtacagtaataataggtttattttttctatttcagagcaataaattaaacttcaaatcaaatttcaattttatattgctctatcacaattgtatttaatttagaaaactaaaatacagccaggcgcggtggctcacacctgtataatcccagcactttgggaggccaaggcaggcagatcgcttgagatcaggagttagaaaccagcctggccaacatggggaaaaccctctctactaaaaatacaaaaattaggtgtgcctggtggcacgcacctgtaatcccagctacttgggaggctgacgcacaagaatcgcgtgaatctgggaggctgatattgcagtgagccatgatggcaccacaaaaaaaaagaaaactaaaatagcgtaccagtcgcaaaaaatacatataaatctatatgtttttcatatattatcgttaaaaatttattacagctacttgattttatacagtttgttccttctaagcaagggtggcttttttttttttttttttttgagacggagtcttgctttgtcacccagaccagtgtgcagtggcacgatcttggctcactgcaacctctgccccctgggttcaagcgattctcctgcctcagccttctgaatagctgggattacaggtgcccgctaccacacccagttaatttttgtatttgtatttttagtagagacaggatttcaccatgttggccaggctgatctcgaactcctgacctcaggcgatccacccacgttggcctcccaaagtgccaggattacaggcatgagccaccacatctggccaagggtggcattttaatcttattttctacatcatgctggtgagcttcacatacaaaatagctgttcaatgtgttactttgttaaaagccttctaggtgaacacttgaacatgttctaagtgaatagaaaatacatctttcctgtgttctgcaaataagacaatttgattcatttggattgttaatagaattaatgctcatgtcacaagctggtagaatcataactctcgtgtgagttatataaacctatagctgttcctgtgtggtttttattgtctctcatctcctaatatatcagtaagtgttttgtgtaccaatggttcagaaaacatcggaattacagatagaggaactgaacaaaacttgcaagcttactaatccatgagtctacctagaatgagacttcactgatagttatattgtatatgggttcacactttttcagatgtgtcactatgcagaaaagcttaagaactgttaatagttcatatagaaccccaaatggtagttcaagataaattgcagccacaaaacttcagagataattcataaataattaaccttgcttgatgagaggaatgagcaggagcattgttgtgatagagaaggaccctctagtgaagctttcccaggcatttttctgctaagcagatgttatcatttctggctctctagaaagtcaacaagcaaatgccttctaagctcttctattatatgcagcataggttaagtaggtttaatcaattctgacagctactgtaaactctgaaagaataaaataagagacctacataatacagtaaggattgcggggattaaatttaatataagccctaaataagacattaccttggaaaatcactttatttgaaaagattgacttttttttaacaattcaaaacattaatacatacttgctaaaattatagatttgaacatgtgatatctagccaatagtgcagtttatattttatctgtaaaatgacctgatgcaaattacaaattttactcacttaaaaaatttaacattgtaaaaatgtgctttcacattcaagataaaaaggcgagggtaatctgcttttggttaaaggatttccatatgattccatgttaaaattagttaatattttaaaataaaaatttcagaaattacagtaagacattaaaacatgcatggtattctaaatacgtgcaactaattcaggctaattagaaacaggtacaggactcagtgttcacctacatttcaagtataagatagacctgtggggaaaaagttaatctgtaccttacaggcaaagtaattacattttactttgctaatagaagctgttaactggagttgtatgtatattaacagacagtagctgtagttgtatagtttagaagtggaaagttgcattttgaaatgtaataattctattctgggtcactgttaggcacaacatcccattgagctgtgatgatacagtatttaaaatattttaactttattcttattactcagcaatcagtgggaacttggcaaatatgagaagtgctcgatgaagacaaagtacaggtgtacctcattttattacactttgatttattgcacttcatagataatgcacttttttttccttaacaaattgaaggtttttagcaaccctacatcaagcgagtctatcagctgaacgtgtttccaatagcatgtgctcatttcatgtctctttctcacattttggtatccaaactttttcattattattctgtctgttacagtgatctacagtcagtgatctttgatgttactattgtaatcattttggagtgtgcccataggatggcatacttaatttttgtgtctattctgactgctccctcttccttctcccttttctctcccacttcttgggcctccctactccctgagatacaacattactgaaattaagccaattaataactacagtgacctcttaagtgttgaagtggaagagatgcacatctctcattttaaatcagaagctagaaatgattaagcttagtgagggaggcatatcaaaacccaagacaggctaaaaggtagacctcttttgctagttaaattataaatgcaaaggaaaagttcttcatggaaagtaaacgtgctactccagtgaacacactaatgataacacaaaacagccatactgctaacatagagaatgtcttagtggtctgggtagatcaaattatctacaacatccccttagcgaaagcctaaccagagaaagaccctaattcttttcaattttatggaggcttagagagatgaagaagctgcagaaaaaagtttgaagctagaaaaggttggttcatgaggtttaaagaaaacagccatctccataacatcaaaatacaagatgaagcagcaagtcccgacatagaagctgcagcaagttttccagaagatctagctaagatcattgatgaaggtggctatactaaacaacaaattctcaatgttaatgagacagccttccattggaagaagatgctatctgggacttttttttcatgcctgctaacaccatatccattctgcagcccgtaaatcaaggagtaatttcaacttcaagtcatattatctaagaaatacatttcataaggctctacctgccataggtagtgattcctctgatggatccaggcaaagtaaattggaaaccttctggaaaggagtcaccattctagtgtcattaagaacatctgtgattcatggaaggaggtcaaaatatcagtgttacaggagttgggaagaagttcattccaaccttcatggatgactttgaggtgttcaaggcttcaatggaggatgtaactgtagatgtgatagaaatagcaagagaactggaattagaagtggagcctgattatgtgactgaattgctgcaatctcattataatgatctcattataatataattatctcattataataatctcaccatggggcggtgaggagttgttccttatggatgagcagagaaagtgatttcctgagatggaacctactcctggtgaagatcctgtaaacaatgttgatatgacaacaaaggatttagaatattacataaacttggttgataaaacagcagcagggtttgaggccagttttgactccaattttgaaagaagttctactgtgggtcagatgccatcaaacagcatttcacgcttcagagaaaatctttcaggaaaggagacatcaatcagtgtggcaaacttcattgtcatctcattttaagaaattgccacagccaccccaaccttacacaaccaccaccctgatcagtcagcacccatcaacatcacgacatgcatgacttgctgaaaggctgaaatgactgttagcattttttaccaataaagttattttttgttccttggttggtttgtcaccccacctggagagtgcagcagcaggatcatagctcatcacagccttgaactcctgggctcaagcaatcctgctgcctcagtctcccgactagctgagactgcgggcatgtgccaccatgtccagctatttttatagagacagggtcttgctgtgtttcccaggctggtctcaaactcctgggctcaagtgatcctcctgtctcagcctcccaaaaggctagatgacaagcatgagccactgcgcccagcctattttctaattaaggtatgtacattgttttgtttgttttttttttttagacataatgctattacataatacactgtatatagtgtaaatataacttttatatgcactggaaaaccagaaaatttgtgtgactcctttatagtgatacttgctatgttgtgatttggaaacaaacccacaatatctgaggtatgcctgttaccagggtaggagacatttttactacaagaaaggttttgtgtcaaataccattcaaatttgttttacagcatatttttatttaagacttatgaacagtaataccttgtgtaattattgctttctatttttatataaaaataactacctcattacttgtttatagctgataagataatcccttctttcattaaagtttgcattaattctgttaatatttttacctaaatttgtactggtttgtggtctaaaccaatatggcaattttttcgaccacctctatagaatggtcatttgccagactttgaaaacattgccaaagaacagcccatagtcctgaattacacactttgcctgtaatgtgtagattaactgttttcccacaggtctgtcttatacttgaaatgtaggtgaacactgagtcctgcacctgtttctaattagcctgaattagttgcacgtatttagaataccatgtgtgatttaatgtcttactgtaatttctgaaatttttattttaaaataataaattttaacatggaattatatggaaatcctttaaccaaaagcagattaacctcgcctttttatcttgaatgtgaaagcacatttttacaatgttaaattttttaagtgagtaaaatttgtaatttgcatcaggtcattttacagataaaatataaaatgtactattggctagatattatatgttgttcaaatctgtaattttagcaaatatgtattaatgttttgaattgttaaaaacctcaaccttttcaaacaaaatgattttccaaggtaatgtcttgtttagggcttagattaaatttaatccccgcaatccttactgtattatgtaggtctcttattttattctttcagagtttacagtagctgtcagaattgactaaacctacttaacctgtgctgcatgtaatagaagagcttaaatctcagtcactcttactatttgtcttctttatttctctcatgcacacaaactcttacgtgaggtttggctgctatttcttgtgccgtcactttttacaactttatggccatatttatcttgcagtttgaggctgcttctttttcaagtatgggcgtaggagagtttttttaaaaagctattgttggtttgacatttgaaatgtttcttgtggaaaaaaaatttttaattttttaaaaatgtcatttatgtagaagatatagaaaaacatcacacagaaaatgagaaagacaatatgaaaattgcatgactttttaaaattctgatctccacaaaaagtttttaactaaaatatgcatgaacctttaataaataattctaagttgtttgcattttatgtatttttagatgctgctgttaattctggagaactgtggtttgtaaatttttactccccaggctgttcacactgccatgatttagctcccacagtatgtatttttcacatcctcattactagttttatttctaattgatctgcaatttatatgttagaatttttttttctatgaatagtaatcaaaaataattatcaaatactttaaatgtctggtttaaaaatatatagcttggagtgtgttcaagggaagaaaagtggtcttatcagagaaatatgttttctttttctgtcatagtggagagactttgctaaagaagtggatgggttacttcgaattggagctgttaactgtggtgatgatagaatgctttgccgaatgaaaggagtcaacagctatcccagcctcttcatttttcggtctggaatggtaagggataaagttagcattttttaaatttgtgaaacattatgacaagttaaatagtagagaaaataacagtatgtagaatttgcagaacattttaagtcttgttttacaaggtgccatctcactagtcttctgtaataataaacattttggattatgaatttttttttttgagatggagtctcactctgttgcccaggctggagtgcaagggtgcagtctcggctcactgcaacctctgcctcctgggctcaagcagttctcctgcctcagcctcccgagtagctgggactacaggcacccgctcccatgtctggctaatttttgtatttttagtagagacggggtttcgccatgttggccaggctggtcttgaactcctgaccttaggtgatctgcccacctcagcctcccacagtgctgggattacaggcgtgagccacagtgcctggcaaaaaaaacaccattgactttgctatattttaaaattaaatgtttgccaatttcagtttctgtcttaaggaacataatttatacaatatgtatattgtatttggtagtttacaaagtattttacaagtgttgtctcattgaatgtaaagctctgatatcttttttcttagtttccagtgaggaacctgaacgattataaatggtattattaaaatgtgttccatagaatctgtactgtcaagattatcaggatatcatttggaaatacattctgctattgagaaatagagctttgctgcattattcaagataatgtaaaaatcaaactctttggtattatttttattgagttttaaaaagaaaaagtaaaagatgtttctcttcttacaaaaaccaataggccccagtgaaatatcatggagacagatcaaaggagagtttagtgagttttgcaatgcagcatgttagaagtacagtgacagaactttggacaggtaattttattttcttaatttgcttgattttcagggtattttgaaatcagtattttgtttttaatggcaatattaacattttggtcatggtattgaaattttaaagtgtcttttccatgtttcttagaagggaattgtgtcatttactctgaactctgctgaatttaacaaactagttaaatttttacagaaacttgaactatcgagatatgggaaatggatatgagatagggctacggtaaaaaaggcatctctcaaagtgcaaaaaatgttttgtaatacaagtgttttattgcttttttaaatatgcttatcaatcagtaaattcaaacctattctgtttaattttaaagtttaaaaatgcttctaatcttaggcttttaactcattaactgcctttaggcagattaagctaataatagtatttgtggctcaagatgttcattttattcattgagtaaagttacgtgtcagaaactattaaatagtggggctgcagtaataaaatatatagtccctgccatcagtgacttcattagtgaggaaaacattagtaaacaattaaaatgcaatataggtactattattatagagcttaagggagcataagatgtgtaaaacaacccagttggggaaaagagaaagagttagaaaatacttcttgaaagaagtcatatccaatctgtcatgaaaatgaataggaagccttaggagatcactgtgtatttggggaactggcaatacttcatgaatctgacaaaaagatcaataattgggtcaagtggtgtggggaaatataatatagctggctaaataggtaggcaaagctcaagtcacaggggcctaacttgccaatttgagtttttttcttaatgaaataatgaatttaggttttatatgatgaaaaaattggagagccattgaaggaatttgtcatactcaagagtatctttggaaagataactggtaaaactcagagtggattagaagagggtgagattagaaaggaaaaattacttagaagactgtttccattagtaaaggagtaataggtgatcagaatttgctttttttcttttatttttaaggaaattttgtcaactccatacaaactgcttttgctgctggtattggctggctgatcactttttgttcaaaaggaggaggtaatactattttttaattttgttggaatgagaacatgacatttaaatttttggtgacagttttaagtatgctactgtaattgattattaagtactagaaactacaatttatgcccaggattacaatttttttacttaatgaatattcgcctttttcattattttacacatgaggttattattcattttttaatgtatcctctatgtttttatgttcagtggaccagtttttcagcttagactcatgataaattgtaccttcagatagccacagatgttatttgacaatttgcaaaaataactagttgtttacagctctaacccctcccaaaataataattttttggaaatatggactttgcttcatgcttatatatatctctcaaacatacatagatttgcctcatacaattatatacttgaagatgacagcttcttctaggaacctttccttgaataaattaagttgaaaattcagtactctgcatagcaagccgtaaactgtaaactgtgttcaagcaatgtggttggttaaaaattgttctaagacaacaaaatattataactcaatgtatttgcatgtatttaatcccaacatgagtcttctccccacatttcatctctcagccttcatgctgctatattgaaaaggtactgccttgtaactaaaatcaacccattaccccatcctgtaaggcctatgctagaaagacactgccttgcagcaaaacgtcagccttaaacttaactaatcaccaagggattttgtctcattttggcctattgcccaaatttctgttcatccacacatgaacaaaagttcttacattctctgagattcttttacttctcacctcaagtaaattgcttctccctgtctttgtaggctctgtgatgctatagctctctttcttctaaatcttctctcattgtattctagtgttcatatttgcagaactttcataaaaatagtgaaggcactatttaaagattttattgtattttgaggatcctttatatacttctatcaaatatctattacattttatttccccccaattttgagatctcttggataaaatggattgttgataggaggagagattgagagtattaacctaaagagagaaaattactttttctctgtagctagacatcctagaaattaaagggagagaatgaaagaaagagggagcgagggagtgtgtgtgtgtttttgtgtgtgtgtttgtatgtgtgtgtgtgtagaaggatttccatatctatcaatagagtccagctcaattaattgccttcgaatgaacatggtaatttgggggaaaggcaaatgcaagtattttcatcaggcttaataaaggtaaaactgcctcataaggtttttttgtccccagattgtttgacttcacagacacgactcaggcttagtggcatgttggtaagcatcaatcattttgtaaaactatatcaccatgtaaagaaacacatttagaaattgatttgaaacattttcttcccttatttcttgaacatttaactcacctatttgtaatcttattttctgatgactgtattcatagctatgtgttttttcctgaataattagttacgttcaataaattttaacgtggtatcaattctaagtgtcatttactttgtaagtattctgtaatttataagttcctcttcaactgaagttacatgttagtgtttttgtcatttcccaactttatcttttgttgttttcttttttagtcatttttaaatgtatatagctctcatgttatggctgggaagtagcctgagtgatgttgattttttaacaccattgaaataccctttgtggctttgtggcttgacaaagccacacaaattgtcagttttgaaaattttggaaattctttgtgagcttgaatataataatgttatgttaggtgtaatatatgttaggtgtagtattacatttattagatcagatttattaatcatgttatttgtttttggactacatgatctataatttctaagagggatgtattaaaatctctaccatccatcattgatttatctatttcttatatttctgtcagttcttcctttacatattttgacattatattgttggcagcagtatgatcattatatcctttggcggctatttatttctctttgtgcattatggatttgtttacacaaattctgttttatttgatattaaaatcactaacttagtatgcttttgtttcattccctttcttatttcaccctatgcctaggcctttagtttttcagcactacacattaaaatcacctgaggagcttttaaaaataataaaaaaacaaaaccatgtcccccagaccaattaaatcaaaatattcgagggtgaggactgagcattagtatctttattttttttttaatatttggtgatcagagtgattggcctatatttttcctttccagtaaagtctgtgcacttttagcatcaaagttaggctggcctttaaatgtgttggaaagtattatctctttttctcttctttggaaacagtttctgtacaactgttgttatttctttctcaatttttttttttttttggtagaatttatcagaaaaccatctgggcctgaagttgtctttgaatccatatttatagacttttctccaatctctctcagatagatagatagatagatagatagatagatagatagatagatagattttctacttcctctatttggtaaattctgtttttctaagacttcgttctttgaagcaaatgtgtaaatgtattgctataaaattgtacataatatcctatttttttatatctgtagtatctatagtgatgttctttcttactttctgatcatattttgtgtgtgtgtctcatgtctgtttttattcttattctgtccaaggagaggtttcttaacctttataagtcttttcaaagtctcaagtttcagctttattgatttttttttttttactgccagtttcttgatttcattgacttaagcactatatttccttccctctacttttttatgatttaatttgctgttcttgaatgattagttcattgatcttaggctttcctttctaatatatgaatttagattataaattagtgactacagctttagatacatcttctattttgatatatatatatagtattttgattatcagtttaaaatattttttaatcttgatttttatttctctttgaatcacagattctatattttttgttcctaatcataaaggttatttttaaaagtaattttgttatttttggctagcttgattctactgtggataatgaacatggaatcagtttttttaagttgttaagccttgtttcatggcccaacatatggtaaatttttataaatgtttcatatgcatttgaaaatgaatcctgtaattcacaggtacacatttctataaaatcagttgggtccaatttgttagctatgttaatcagatcctctagatcttaataattttattgtctgcctattctatcaataactgagagagtgtcttaatatcctccactactttgtggatatttctatttcctttgtttctgtcaatttttattatctattttgatgctttgttattagatggatattaatttagaattgtatgttttcttggtgatttgaatctctaacctgatgaaataaccctctttatctcctttcgtgccttttgcctccaagtctaccttgactgataactaatatagctacaccagctttcttttgtttaatgttggcatttttccattttttactgtcacccttactgtatccttatatttattgcctgcaatcagcatgtaattaggttttgtatttatctagttgctattttttatcttagtccatttacatttaatgttattcttgatatatttggccctatgcttaccatcttgttagttttatatttgtcctacctgttttatagtccttttttctttcctttttgcttcttttggattaagcaagtgatttttaaaatttcatttcccatctctactagctctttggttacctgtccttttattgttcatttaatgggtaccctagaaattttgtacatgtatcctgacttactcatttgctacctaacgcaagagtactaaacagaaattattttactacctctgaaactttgctgttatgtattctaatcaaatatgtttttttctaagttctgtcttaaatgcagtaaagtgaatacatcttaaatgtacaacttaatttttacatatatatgctcccatgtaacaccacctagatcaagatctattctttcttagcttttaattgtttgtgattttctgaagtttcattatgatatacataggtcttgagtttcttatttattctgattgagattaactggacttcttgatcactgtaggttaatatctttcatcagttgtggaaacctgtcagctggtatttcactttttgtttctatctcattctcccttatctttccgagatcccagttgaatgtatgttagaactctatttgtttactaacttgcccagtgcagaaatttttttcagtaacttaaggttatgagaaatgtacttttcgtacaggatttttggagctcactaaaggattagcttagccactgtagatgaaaactgggaagatactaatttaaatgcacattgtagacacatacagagaatgtctcataaactgtataattactaaaaggatagccacaatgaaaaatcttaaacagtagtttggtttattttctttaacctgaaagactattggacagctcactttctataaaaattgtaaatgtcgttttttgtggattcgtagaaagaattataaaaagtagatttctactattagggaaaaaccatttctcaagttactaagtacaattttttgcacttaatatttctaaatttattaagtaatttataatattagaaatctactttttaactttgctgtagaactaaggcatgaagttttaattttttggtagaaaaattgtgtttttagctaagtaaagctctaaatccctttaactttttgcctcccatttacaacatggtttgttgtttctttccattttaggatggtcttgttaatgtaggatggatggactgtgccacccaggataacctttgtaaaagcttagatattacaacaagtactactgcttattttcctcctggagccactttaaataacaaagagaaaaacagtattttggtatgaatcactttaaactaatttatttacatataatgtgcaaacaccctcaaaaataatacattatttttgtaagcagtgagcaaagaaatgaacaatttatattgtctgattgtggaacccttatttagaacacatacttaatttctgagattctttttaatacatgcttcaaattataaaatttaaggattatttttaaactgacgattacatttcatttaaagtcattacatctttacatttaaaattaccttacatttaaaaccattatatttttaaaccccaaaagtatggagtacattcctgggttatacgaaagagcatttatagcatgagttttcattgttttctatttaattgtttattttgttttttttgagatggaatctcactcttgtcgcccaggctgtagtgcagtggcgtgatctcggctcggtgcaacctctgcctcctgggttcaagtgattcttctgcctcagcctcctgagtacctgggattacaggcgcctgccatcatgcctggctaatttttgtacttttagtagagacggggtttcgccatgttggccaggctggtcttgaactcctgacctcagatgatccgcccatctcggcctcccagagagctgggattacaggcgtgagtcaccgcacctaacctaattgtttattttctaatgttaaaaatatagatcagtggtagttttggctggggcctaagtatttttctaaagcaccccgtgggattctggtgtaaactcagttttgacatcttgtaatgtggtatacctccttaagtttgagtgaggaaactgaagctcaatctagttgtcaaggagctaagataaatagtgggatattggatgggtcactacggaatcccaaaagaaagtaaggactgtgataagacaaatctcccttagttttccctctgtactttaattctgcttttttagatgttgataaagataacatatactcatttcagaaattcatatatggcacagagctgtaaaagaagatgcaaaattccctaaaaccaaatcactaatagacagccaccatcaaatcttggtaaatacccatccagatctctactgaaatatatatgcaattacgactttgtgccagcaattctctagtttatacctgtgactcaaacctctgttctccactccagatgtattatacacatgcacctatacgtatatgtgtggatgtgtgtgtgtgcttgtgtatgtatatgtgtgtgtgtacatacttacatatcactgctcattcaatatcttccttaggatattagtcagtgtctcaaatttaaatgcctataaccatattcccaatatccctccataaatctgcttcatccagttttttcccatattatttgatgaaaactctgtcctttattattcaagccaaatgccctggagttattcttgatttctctttttctcataccttataaccaattcatcaagaaaatctatggctttatctttaaaatgtgtttatacacatcaaatggatggatggatacagatacgtaatttttcataaatgggattgcatagtagattctattttgtaatctagttttttcactcagtgtatcaggaagatgctttcttatttaaaaaatgtacattttatatgcatactttatcattttataaatgaatatgtatacattatccttgaagtaattaatgatccctggatggtaagtcactgactagatgtgacatacttagtttaatcagttctttcttggtgtgtgtttctactttctcaagatgataagcagtgttgtaatgagcaatcttgtatctttatccttgtgcactttttcagttatctgtttagaatgggagcattgtggccattttaaactcaattggtattgccagattgccctccggaaaagttgtactagtttattctgtgccatccgtcaacaaggattgcctacaccctgtccaacaatagagcctcttgccttgagtattataatctctgggcttcatgatagaaaattacaaggtcaaaggctgtctgagacaggaaacagaaatgagtgactctggaaatgtaataacagggagtggtgaattaaacattacttgtccctccccaaaagcagtcaggttttttttggtttttttttttgagacggagtcttgttctgtcgcccaggctggagtgcagtggtgcgatctccactcactgcaagctccacctcccgggttcacaccattctcctgcctcagcctcccgagtagctgggactacaggtgcacgccgccacacccagctaattttttgtatttttggtagagacggggtttcaccgtgttagccaggatggtctcgatctcctgaccttgtgatctgccggcctcggcctcccaaagtgttgggattacaggcgtgagccaccgcacctggccgcattcaggttttaaaaaatataaaacagtatgccagctaaatatatctggtaggtggaattcagaggctagataagacagcagtcctttataggtgtaactaacaaattctcctctaacagaaacaggtttataatgagattctagtagattaagcactgcaagtttatataggctgtgtaataggcattttagtaaaagtcttcatagtgaataggactaaagtgaataagatgtagaactgaggcgtgaaagatttgttatggcattttaagctctttgatagcaggaactatttcatatagacctctaagaatgtttatgatatatatatatatatagtatatatcatatatatttatatatatttatatatataatatctcatatatatttatatatatatatatctcatatatatatattcagttttaagaaaagaatcttagggaaaaaacctgaatttttattcttatgttgtacctattatttttagccatatgtttgttctcatgtctagcatgattaaactgtggattccatgattgttcgtacaagtttttagtgaattttagatctttcaagtaatacttaaactgttaaacatagatggttcataattaaagacatatattaaactctgttttgtcaactttcatatacattttcttgatgtaaccattgctgcattctttataataacagctgcttcattgagagaatcagaccagcagagagagagagttatatgacaaaatatgctgaggataaaatattgacaaataaagaagatttgttagaagggccttttatactcgtttgtgttttaaataagagactcgggccgaaaacaagtttaagataagatctgtatcattgtattttactctaaaaactcctaagtggtttggtttttagatgaaaacctctataatgagcaaaagtccattccaattttccacttctaagttcctcttaattaatcttaattattggttggggaatgaagtgtctttgatagtctattattcttccttctagtgttataaaaattcttaagtgaatgtgtaaaacattggcattctgtaaaacatgattagcattaaaattaagctaaagataatgtggtttttcttgatgattgggaggtcactcaggatttttctgagcatttttatagaatacacatcatagttaattaaaaattccagttaatgcaacatcttataatggaatttattgtatatcactatttaagaaacagcttagttatataatatttttgataattgccaaaatacactttttttgaaaaaagacatttggaattgtttgaaaaactatttaccttctataatcattttcctaaaaatactacattggaaattgaaaaaacaaaagatatcaaatataatgaatatttattcaaaaagattacaatgtgattttctttttctagtttctcaactcattggatgctaaagaaatatatttggaagtaatacataatcttccagattttgaactactttcggcaaacacactagaggtaatgtttttattaataatgataagtagcaatgaatgttcgtaacatttcaggtcttaacattttaaaattagcatttgttttattcatctctagagagaattgaaagtagcagtttcaaaggattatatattagtcaattgtaggttaaattctaattggatatctggtgttgctaattcaggatggatctgtagttctggaaaacctactcagtcctgaaggtgggcttcaaaaggaacatcagaaaaggcagaattttaatcagagcaactttgggtctgattcataactttttgttcttgcttacagaacggattatattgattactaagaagaagtattcagtttatggatagaatgctgagaaatattgcttgtggtagaatcagttttttttcctattaggttggtgcaaaagtaattgcagtttttgccatttgaaagtagtggcaaaaaccacagttacttttgcacaaaaccaaatacttcctaaccacagatcttttgaagtctgtatcactacgagatcttatgtgctaagcctgaaaaagctgacaactttgccacccaactttttagctatatgctgttaaaatcatgtatttgtttttggcagtcatctactttaagattttataatttagtgactaaccctcctgtaatatttgttgattttacatagcattattctaagtaaactacaaaataagagaatgagtgggtccgaattttagacagtattttgaaataatgggtaggggagctaaaactaacttcaagtcatagaaatgaagattagaacccttagaatttcccatctctgacattttgttttctttatcacttttaaggatcgtttggctcatcatcggtggctgttattttttcattttggaaaaaatgaaaattcaaatgatcctgagctgaaaaaactaaaaactctacttaaaaatgatcatattcaagtaagaaaaatgtattctgcctagccttctgctggtgtactttgttgttaatttaatgcatataattaaattttaaataacataaaaactcttatttgaaattataagaagcctataagtgcttttagtcttggtttgtgcttgcttttcctcttttttattaaaagtttatatgtaatctgaaagtggttaattttcacttattttggcatttgataaacctgtatcatacaatttttctggaatgcatactgtaggaggttatctttccattttttaaattcttatttctttatataagtaattcttggtcgttgtttaaaaatcaggacaataaataagtacaaaaataaagcaattatctaaaaaaatcacccatactcttaacattgttcataaccctgctatgtatttactctatataaccatttaaacattttgtgagtgcccatatgcatatgtaggcatatgtatatgtgtgcacatgcatacatattgtaatggccattgtaatagacatacacgtgtaaatttatatgtctgtgttttaatcaaaatggattcactgtatgcttttttttttaacttctgtcatacaacaatatcataaactttttcacagacctgtaaaaatgcatatatatttatatggatataaaatctctatatccatgtacacatgtatatcctccttattccctaaaggctacatagtggcttactatatggttatgccataattgtttaggaaatcctctcttactgattttatgttgtttcctttattttttatatcaaacgatgcagaacttgtctttaatatgggaaattttcttctcttttcttttgagacagagtcattctgtcacccaggctggagttcagtggcgtgctcttgactcactgcaacctcagcctcatgggttcaagtgattctgggttccagtgattccctccagagtagctgggactacaggcgcatgccaccaagtccggctaatttttgtacttttaacagagactggatttctccatattggccaagctggcctcgaactcctgacctcaggtgatccacccacctcagcctcccaaagtgctgggattacaggcgtgagccaccacacctggccacatgggaaattttcaactcaaggttatgttttcttaaatggtttttattctcattactagagtcctccagaaagttttatcagtttataatctcactgacagcacgtgagtggccatttctccacgctgtgcccaccatggtactatcgttctttataatcttcacaattccgataggccacaagtgatatgttaacaatattcactttcatttaattgctttcaactggtcggggaaaaatactttttcatgattattaacaaatcataattgttctctagttaattttctctttatatctgtggcccattttcttttttctgatgggatgtttgtccagctttttctttgtttttttttctttttttttaatgcagtgtagtgtcactctgtcagccaggctggagtgcagtggtgcgatctcggctcactgcaacctccgcctcctggattcaagcagttctgctgcctcagcctcccaagtagctgggactacaggtgcaagccaccatgcctggctaatttttgtatttttagtagagacgtggtttcaccctattggtcaggctgatctcaaactcctgacctcaggcaattcagctacctcagcctccccaagtgctgggattataggcatgagccaatgcgcctggcccttcttgtttcttaatggatcttctctcttaaatgccacagatttgttcctggtttatatttggctgttgtgcttacgctcttctttttcacactctttgaaaacatcacttttttcttcattatttctgcttctgaaagtgatctctcctctatctcaagattatataaacattctctacatcttcaaaaagtaggtttctggaataacttcatattttcttgggaattcctcaggttttttttaactctctaggaagcatttttttaactaaattgagtcttaatattaaatgtaaatgaattatttctgtctcttattttcgtagcctattagcttctgtttaaaaactgtgtcattagggcagtgccatttttggattatcatgaatatttacaaatcaaatgggtaagacagtgtttttatcaaatttgacctttttctcctttaggttggcaggtttgactgttcctctgcaccagacatctgtagtaatctgtatgtttttcagccgtctctagcagtatttaaaggacaaggaaccaaagaatatgaaattcatcatggtaagaatggaaaaaaatgataaaaaaaaacttagcttcattttcaaatagaagttttctaattgtgctttttaaacttattttttacggacatgcttattgtaaataacttttctcagtaaatatgaggacagatattttgaattatatgtagtcactttattctctttacccttctttttaacatgaatgccttttctctattcagtattttgatcaggatttctggtgataagtcaagctagtgagaaatttaagtcctgcttgtttgcaaaagtaagcaacacctgcagtttatattccagcttgccatgtgtatcatctcagccattataggcaatttccaaacattcttttggatgtttctcccactagacttccagacttcttcattaactgccttgttatctttcttgcatttataattttatttcagcttatttgggactttagctctgcattcatgtgagtgcagtctcaattccaagagtttggactacagcagagtccttgtcctgaaagaggtcaaatatagcaaaagaaacacacagactaccaactaccatgcagttaagtgaacaacagataccgatgaaatgcccattagcacctagcactgctttcaatgttgaggatataaatttgtaagacatgaactccttcaagaagtttaaaatagtgtagcggggaacagaggagggagatccataagaaaacaaaaaatactttaatggtcattgtatattaatgacaacaagatcaaatagatttctgcatagtagaggtcaagaagtggtatttgaattgagcataaagtgctcaatttccccaagcaactataggggaaaagaagtgagacctctaggctggaggaactttggggtaagataaccctcacagtaactactgtttattcactgctgtctccaagtcagacattctgccagaagccttgcatacgtgattcatttttatctttacaacagcccagtgaaggagaaaatggagactcagaaaggttaagtaacttgccctatgacagacatactagaaactagccatggtagattttgaatccaaatttgtctgactccaaaacctaggctaatagccgttaaactataccatgcactaaaagtgctagaaatgactaagttttaataatggaataatactcttttttatctctgaaatagttctcagaccccccctcttctcttctctgtgcttactgctttgtttcaggcccatcatcgccttcatctatgatagtattatcctctgggaggattgcttatctcctagcctttcttccttaaaatcaattccttgttgtgtttgcagttattacccattcttgtgtcacttttctgccttgacttaccttatttcttatagcataagcgtcagattccttagcatagaagcaataatctcatctgttttgctcactgctctatctccagcacctagaatggtgtctggcacatagtaagaactcaggaaatgtttgttaagtggatagggtatgttcacagtctggctctgccagtttttccagtcttaattcccactgctgcccctccagatagtcttagctccagctacctttggatgtttgtgaatgccatgttctttcactcctctgtgccttcacacgatttttcctcctgcattataatcactccttcctgttccacagaatatttagcaaactccaaattgcctttcaaaacttaaagcagcttcttccctggaaaatatattatgaatctccaagcacttccttttatgtgctcttactaactttgtaatagaacttacattgtttctttggattaaaatagttattgagcatctgcatgtaccaggtacagtactgaggaataggaaaaaatgtgaactatacttagtaatctctaatacaaagaacattgtggactattagggaaaacagacaagtaaactaacaaatttttattttttttttttatggacaagttttttttttatttgaatttttttttaatttattattattatacttcaagttttagggtacatgtgcacaatgtgcaggttaattacatatgtatacatgtgccatgctggtgcgctgcacccactaactcgtcatcgagcattaggtatatctccccatgctatgtctccccactccccccaccccacaacagtacccagagtgtgatattcccttcctgtgtccatgtgttctcattgttcaattcccacctatgagtgagaacatgcagtgtttggttttttgtctttgcgatagtttactgagaatgatgatttccagtttcatccatgtccctacaaaggacatgaactcatccttttttatggctgcatagtattccatggtgtatatgtgcccattttcttaatccagtctatcattgttggacatttgggttggttccaagtctttgctattgtgaataatgccgcaataaacatacgtgtgcatgtgtctttgtagcagcatgatttataatcctttgggtatatacccagtaatgggatggctgggtcaaatggtatttccagttctagatccctgaggatctagactgacttctacaatggttgaactagtttacagtcccaccaacagtgtaaaagtgttcctatttctccacatcctctccagcacctgttgttttctgactttttaatgattgccattcaaactggtgtgagatggtatctcattgtcattttgatttgcatttctctgatggccagtgatggtgagcattttttcatttgttttttggctgcataaatgtcttcttttgagaagtgtctgttcatgtccttcgcccactttttgatggggttgtttttttcttgtaaatttgtgtgagttcattgtagattctgcatattagccctttctcagatgagtaggttgcgaaaattttctgccattctttaggttgcctgttcactctgatggtactttcttttgctgtgcagaagctctttagtttaattagatcccatttgtcaattttggcttttgttgccattgcttttgttgttttagacatgaagtcctttcccatgcctgtgtcctgaatggtaatgcctaggttttcttctagggtttttatggttttaggtctaatgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtatatatgcggcgttatttctgagggctgtgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaaggcattggtagcttgatggggatggcattgaatctgtaaattaccttgggcagtatggccattgtcacaatattgagtcttcctacccatgagcatggaatgttcttccatttgtttgtatcctcttttatttccttgagcagtggtttgtagttctccttgaagaggtccttcacatcccttgtaagttggattcctaggtattttattctctttgtagcaattgtgaatgggagttcactcatgatttggctctgtttgtctgttgttggtgtataagaatgcttgtgatttttgcacattgattttgtatcctgagactttgctgaagttgtttatcagcttaaggagattttgggctgagacaatgtggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaatttatggagagtttttagcatgaagggttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattcagtttgccagtattttattgaggatttttgcatcaatgttcatcaaggatattggtctaaaattctcttttttggttgtgtctctgcccagctttggtatcaggatgatgctggcctcataaaatgagttagggaggattccctctttttctattgattggaatagtttcagaaggaatggtaccacttcctccttgtacctgtggtagaattcggctgtgaatccatctggtcctggactctttttgtttggtaagctattgattattgccacaatttcagctcctgttattggtctattcagagattcaacttcttcctggtttagtcttgggatagtgtatgagtcgaggaacttatccatttcttctagattttctagtttatttgcgtagaggtgtttgtagtattctctgatggtagtttgtatttctgtgggattggtggtgatatcccctttatcattttttattgcatctatttgattcttctctctttttttccttattagtcttgctagcggtctatcagttttgttgatcctttcaaaaaaccagctcctctttctgctagcttttgaatgtgtttgctcttgcttttctagttctgttaattgtgatgttagggtgtcaattttggatctttcctgctttctcttgtgggcatttagtgctataaatttccctctacgcactgctttgaatgcgtcccagagattgtggtatgttgtgtctttgttctcgttggtttcaaagaacatctttatttctgccttcattttgttatgtacccagtagtcattcaggagcaggttgttcagtttccatgtagttgagcggttttgagtgagattcttaatcctgagttctagtttgattgcactgtggtctgagagatagtttgttataatttctattcttttacatttgctgaggagagctttacttccaagggtgtggccaattttggaataggtgtggtgcagtgctgaaaaaaatgtatattctgttgatttggggtggagagttctgtagatgtctattaggtctgcttggtgcagagctgagtttaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattaggtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagcagactgatgggtcttgactctttatccaatttgccagtctgtgtcttttaattggagcatttagtccatttacatttaaagttaatattgttatgtgtgaatttgattttatggacaagtttttaaaagtgtttgcagtggagagtatttattgtctattgcttagtagtaaattaccccaaaactcagtggtttaaaacaaacatgtattaattcacagtttttcgtggtcaggaatctgagaaaaatttagctgggtagttccagacacggattttctcatgaggttgcattcaaaatatgcaagggctgtggtcatctgaagtctagactggctacagggtctggttccaagcttacttttgtgattgtcaggaggcctaagttcctcactggctgttggcagaggcctcagttcctcatcatgtgggcctttgtagggctgctctcaatatggtagctagcttctgtgatagtaacagagatgaagagaagtagatttgtaaaagaccaagaatgcaaagtcagtattacttggtgactgatgagatgtgtgggaggtcaagagagagagagagagtcaagaataatacctatgtttctgacttgacgaaattgcagttgagtgattgtaccgttcaatgtaagtggactgtggtagcaatgtagaaaatggattagttaaggaagactgggtgaagaaacactagctaggttattgcagaaggccagactgagttcaggcagtagcaatgggttggaaatggtaagagatggaatggatagaattattatgatacagggcagagaaagaagtcaaggctcactctggggaattatatttaggcacctagtggataattatgttattgccaagataaggttggtgagaaaaggagcaggtttggaggaaaataacacagcctcaatttgaatatattgccatgtgtcaacgacagagacgtcttctgagaaatgtgtcattaggagatttcatccttgtacaaacatcagagagtgtacttaaaaaaaactagatggtatagtccactacacatctaggctatacagtatagcctattgctcttaggctacatctgtacaatgtgttacaatgtactgaataccataagcaactgtaacacagcggtaagagtttgtgtatctaaatgtatctaaacatagaaaaggggtaatgtgttgcactacagagttacaacagccacaccatcactgagccataggaatttttcagctccattataatcttatgggaccccatcatatatgtggtccaccattgcctgaaatgtcattatgcaggactgtattgtgtttgacgtgtttacgtgatatccaagtacagtttttcactgggcagttggtaatatgggttttgaattcataagagaagtctaggttgtagaaaatgatttaggagttaggccatagtaatcactgaagtaagcataattaatttaaagaaccctataaaaaagtcattattctacctctgaagatgagggaacatttcaaagagattttgactttttttttttttttttttttttttgaaatggagtctcactctcaccaggctggagtgcagtgtcgagatcactgctcactgcaacctccacctcccaggttcaagcagttctcctgcctcagcctcctgagtagctgggactacacacgtggccaccatgcccagctaattttttgtatttttagtagagacgggggtttcaccatgttggccaggatggtctcgatctcttgacctcgtgatctgcccacctcggcctctcaaagtgctaggattacaggcgtgagccactgcacctggccaattttgacatttttaactagtccaggaaacagaagagtgtgcaagaaaagggtgctcctatcagagctaagccctgtatagtatacagcacactaaaacctcaccaaaatcaatttgttcataatttatcttctttagtattctgagtattaaaactttgaaatgtctctgtgcatacaaaaagcagaatttggatttgaatttctctcattcactttgaaaggaaagaagattctatatgatatacttgcctttgccaaagaaagtgtgaattctcatgttaccacgcttggacctcaaaattttcctgccaatgacaaagaaccatggcttgttgatttctttgcccccgtaagttatttttatctgtcagattctaacattgtcagatcttctcctgttatggcaaaaagacattttctagataactctgaatcattagtacaaaaactgtgtcattccattatggccactaatgcatattgcttttaaatgagtgctaatgtaattactcctccagggaaggtttgccgctaagtacagtttgtcttacttagcatattacttgttgcagaaatgatgggggggttttttgtgtcatttggctcggtgcttatgaatattttttctttcctagtggtgtccaccatgtcgagctttactaccagagttacgaagagcatcaaatcttctttatggtcagcttaagtttggtacactagattgtacagttcatgagggactctgtaacatggtaaggcaaagtatcaaaaattattctaattaattttataaaatgaagaccttttggctgtttattattaaaacattaaaataacttagaaataatacatcttctatttagagtagtaacaaattatttaaacaaaataatatttttagaaagtggtatcaaatatgattggattaaaccatgcatagctaatcaatgcattgaatgtaaataaggtcttatttatcaaactcaggcaactattttcattaacttcataaaatgcttatatgattttccaattattgaagattgttatatttctttaatatttttgacattttataatttttttcctttggctttcttcatacttctaagtatatttgctggaaagaagttaaaacaatgaacaagccttttgaaatctttgtttaaatgaaattattttctcaggtaaatattcactcctcagttgcaggaagaactaaaaattatataccgtagaatgaaagtacgtaatatcacgtataaaatactttgggcaaaaaaaaaaaaaaaatcaatcctatagtagatctatctccagatctattagtctttaggaaattgaatgacaggggagcatgttaagtgacaccatggatatgaaatctgcacttcccagtatgggagaactttacaggacaaatacccagtatatacattgtatatagtggaggagagattaaaaagacttaaaagactatcagtcaaatacaacatttagactttgtttggatgcagtttaaacaaaccaagtgcaaagaaagagataattggggaaatgtgaacactgacaagatatctgatgatttcaggtaattattgttagtttttgacaacaaaaatgatactttggttatatggaggggagtccttatattttaaatatactgaaatatttgtggatgaaattatagatcatctgaaatttgctttaaaatgatcttgggagtagactagaaagggagtataagtgaagtaaaagtagccatgagtcagtgattattgtagctatatgaatacgcgagagtttgttgctctctacttttgtgaatgttctaaataactcataaaaaataaaatgtttttaaagaacatagatggagaaaagataaagggaaaaaagaaatgggaagaggaaggaaaacaaaagaaagccatacatttttagaacatcacagaagtttaagccagcagcaatggcacatgcctgtagaaatttcattaaaatacatttttataaaaggaaataaacaaggcctttggttttgaatgttttctctgtaactttgaaagaaatgccaaccaaagatacaaaattgatgtgataaacaataattatcttaattttaatttctttagtttagtttttttttttttttttttttgagacagagtcttgctctgttgtccaggctggagtgcagtggtgcaatctcagctcactgcaagctccaccccccgggttcatgccattctcctcccttagcctgccgagtaggtgggattacaggcacccgccaccacgtccggctaactttttgtatttttagtagagatggggttttacagtgttagccaggatggtcttgatctcctgacctcgtgatcctcccacctcggcctcccaaagttctgggattacaggcatgagccactgcgcccagccaatttctttagtttttctacttttcatcttagctcattaaacatatgtgagttcagtgtaaggatttaaaactatgatatcgatttacctggaatagaggccaagattcactactcaccaattagttgccactcaccaattggttgactttgaccaagttacttagcctctcagtaacttagtttcctaatttatacagtgggttttatcattttagcaactaagtataattgttgtgaagaataaatgagaaactacatgttaaatgctaaaataatgctcaacacatagttaaattttagctataattgctttgttaatcagtgaattatttgaatttgcacacatttttcaagactaatataaatgtttccattgttttttcaaaaattatttttgaatcctggtcaaagattccagtttgctaatgagtacttaaaactttaagagtgcaaagttcagctacagcaaatccacagacaaggatctctttataactttttgaaaaataaaaataaaagctttagagagaggcttcctgggctggtgcccattttaattctgagaaggaaattaagcatttcctactataaaggctatcttgaagaagaataaaaagggattacattcatagggcatgattcataattctttaacctaaaatataatcatgtaccccctaattatttgtgtctttattcttgctgttttatttcctgatcatcatctatttctagaaaaagtatttattatggtttaaaaaaaagactcaagctagagatatagcctgttgtttatagcctcttcttaccttggttcaggagagtaaaaagggaccattcgtataattacccatgccgatttctcaatgtttcaatgcctatggttctcatggcgaatggagcagctataaataaggatcaggtattcatcagtatttagcagtattcatcaccataagtcctttgctaaatttggtgagactaaaatttttgtcaccagaaatttagaaatgggtttttaaaatcttgttcttgttacttaaaggcaaacttgttataaatttgtaacaaataggtgaaatctataaaatctttaattcatattctccttcctatcagtataacattcaggcttatccaacaacagtggtattcaaccagtccaacattcatgagtatgaaggacatcactctgctgaacaaatcttggagttcatagaggtatttcagattatagactatgtgactagaaatttgtctgtttctatgtaaaccctgtatgaatgtttcatattgtttaataggatttactcttttcatgcccaaactattttcttacaaaatgatttttaaagaatttttctaatgttttactcttcttatatacttgtctgtaaactcaaagtaaatctgtgttttatttgttacctggtatgtacagtgccttataaacaatggacacaattatttattgaacatatgcaatgtattttcaccttgtcacccctttgcactgttttctctgaaaacaagtgtctggcatctacagcatctttttttttttttttctcagtaacactcttgatagaaatacttacaggggactcctagaaaaaaaaaaagaaaatttctagtttattattatccatttgatgaccctccaaccctgtcctactcacctgttcctcctcctctgacgtaatgttttgtcttgttttcccagtgaagctagcctcttcatcagtattacctgactgttgtaggctgaagctttgttaaaatatcatttggaacaaagaatctgtagaaaggtgtagtatctccagtcagaatgtcagaaaaatgagatagtaggctttccactagtaattaaagaatcatttccaaaccagtcattcttggttctagaacagaactttatggcctctgtagacatccaggcagcccttgaaactcttttattatccatgcagaaacttaaagttgcctctttgcctgttatgattttagtgatacatagagataaaggataaatagaccttgattttttacaaaactaatgagcaaaatccaaacttaaaaatctaagttaggtttattttcatattttaagataattcacattggatttcttttagctatccttaagcatcttttggtttctcaaaaatgggaactttctaaaggacatacacagattgagcacccctaatccaaaaatcttaaatctgaaatgctccaaagtctgaatttcatgtttagacttgggtttcattcccaagatatatgcaaatattccaaaattcaaaattctcaatacttccaagtattttggataagagatactcaacctgtaccaacaatttgccaggaatatatgaacagctatgctttatatatatgttataatggaagctatattctcttcaggatcttatgaatccttcagtggtctcccttacacccaccaccttcaacgaactagttacacaaagaaaacacaacgaagtctggatggttgatttctattctccgtggtgtcatccttgccaagtcttaatgccagaatggaaaagaatggcccgggtatagtaaaaatagtttattttaaatcttaacatttactaagaatgtttatttaacagaattattttgaaacggatgtgaatgaacccacaactaaattattacttaataacagtactgatcataccactttgattccagctctgtttctgtctggtgtgtgaatggtatagcctaccatttttgtgtgtatagcatctggtacactttttttttttggtcgggtagcagggggcagagtctcgctctggagtgcagtggcgcaatctcggctcaccgcaacctcaaccaccctagtagctgggattacaggcatgtgccaccacgcctagctaatttttgtatttttagtagaaacagggttttgccatgttggccaggctggtcttgaacccctggcctcaagtaatctgcccacttctgcctttcaaagtgctgggattacaaacatgagcctccgtgcccagtatatccagtacttttgactaaactgttgccaacaacaacccaaaaatttacctcatatttgtttcaattttttctaatttttttcctgctttatttttagagtttaaaaatatcatttcctgacatactgtaggacttaaaagtaagaaaaaaaagctttcagcatgtgtatttagaaaatttcctgaaaataggcaccatgttttaagttgtagaagattggaaacaaatcacttaaataccagaatggaaaatgcaattactacttcacatttgtttacaagataaaacactaaatctgagttaaagtgatttctagtatcttaacatttaggattacatatttttgtgctcttttcaataaaatttttaagttcaggtgtgagtcagtataacacattagacacctacaaagcttgttttcattggaaagaatactttgaaatattgcaaagactttcattagtttctagcactttgaattttagaagtatatagttttttctcatgtaacagttaaatgaaataaattgtttaatctgcaataattttagtaagtacttaattacaaaattagattacaaattcattagtataaatggtctattatatgttaaacccttatccatttttattgggtaaaagtcactgataaataatataataactgtttcaccataataatacaatgcttatttctttattgcaaacatatgtaaaaagttatggaggtaatctgttttttcttttacagacattaactggactgatcaacgtgggcagtatagattgccaacagtatcattctttttgtgcccaggaaaacgttcaaagataccctgagataagattttttcccccaaaatcaaataaagcttatcattatcagtaagtattctctcatatttgaagacatttattataattatttaattatacacttaacagttaagttacctgaacaaaataaaagttaacccaacaaatatttattgggagcccactacgtaaagatagtttgttaatgaacatttcagaagatgaaaagggagtattgaacagtctcactgtgcataaagcttatagtctagacaaaaagataaggaaaggaagagctaacatttattaagtccttaaacaccttatttggtttcaggtactatattagatactttactcaccttatttccaataatcctcacatatgctctgtgaactaggaattactacccttcctactattacagagaagtaaactgtgattctcagaccttagaatccaaggtctaggagttatctaaggcttagataacttccccaagtcacacagctgctaagttgaagttgaggtttgaacccaagtctgtctcagcacccatgctgtttccacaacaccacgtggtatttcaggtagaaaactcaaatgtaaggtacatatgatgaatgttattaaacaagtaaaaatgaaccatggatttcaagagaggaaagggtcacaactatgaggaaattatgaaaggctgcattttgtaggtagtttttgacatgtgtctttaaaaatgggtaggaatttgacagacagtaataacttgaataaagattcagaaactaaaacccttggacattctgagtttcgcaattcccataggtctacaggagatgtccagtagacagctagacattctgggctgtctggggcacaaagataccaagactagagaaaaatacatttgtgaggccttataaccagaatttgtagctaggtatatttgagaagagagataccagatgaaatcaatcaatataacttattttttaaattgctacaataagattgttttctgaatacatccaataatagagaatcctatttacaactaacattttttcttctctcagcagttacaatggttggaatagggatgcttattccctgagaatctggggtctagggtgagtaattaaaatatatatcattgtataaaatagattcaaagccatttaccccccttttatatcaatagttaaatttactgtgggttaaggttctagcattttaaattacttagtaaagtattatattaaccaagatagtactgtactttattacattgcccttccttgacatcatttttaacttagaaagtattacaatattattgcatttcatatgtttgctttggttttatataatgaaaaatgattttgatcatttgccacagatttttacctcaagtatccacagatctaacacctcagactttcagtgaaaaagttctacaagggaaaaatcattgggtgattgatttctatgctccttggtgtggaccttgccagaattttgctccagaatttgagctcttggctagggtaagtcatacctgtcttaaataagttgtagccacattcatgttttagtaattagataaaacattgtaagtatgtaatttttaggtttttttcttaaatgtttcctctgaatttaaaaatagctattatatttctatgactgtaatggttgtagtagatttcctctttctttgttaaagcttttagctaacatcttctctatcttggtagacatcatcatctactagccataaaagccagaaacgtctctttcttctccctcttgtctactttctcctccccaccccagtactctgttgccctccaggcagttactagattgtgtcagttttatcccctaaatgtctttcaaatgtcatttcttattcatctctactgctaacctgtttcttcaaccctttatcatctcttgtctagacttaaccatatttgccttttaagtgcagtcttcccttgatatactcaggggattggttccaggaacccccattccataccaaaatctgtgcagctcaggcctcacagtgggccctctgtatgcagggtttcacatcctatgactattctgttttccatctgcaattgcttaaaaaaaaaaattcccagttcaagcagttcaacacagttcaagcctttgttgttcaagagtcatctatggtattatactgtctacctttgtcagtgctgccctggtgatcttctaaaatatttccctctctgacttactaagtttcttaatatgcatacattgacttcaggtgtctgatatgagctctatctctattgtccacctcacaccttagattccagtgtaacagagtactccaggttctctgaacatgtgtccttatttacatgccgctccctctctctaaaatgctctgtccttaccttggtcatctgtattttttctcctcttactgcaaaactcagctccgatggcactgctctattctctgcccttctcagttaatcagtgtcacctggatatgttatcaagtgtactgatacagtgcatattaattctttatttattattacttgaaagatatttaatttgaccagaaataaaaggagctggataccaatggaaataattagttgtagcaattttgggttttgttcggttggttggttttatttttcggtatagcattgtccatcttcctttgtaaatggctgtctcttcctgagggcaaagtccatgttttatttatttttatatcctcagggcctaactcagtaaatgcttatataaaattaaactgaatacataccctcaatgcagtctgagcttttggtgtttctttctgtcgtaacagtcttattagtgacctaatccagattgatagctttcttgcctccataactcgaggaactcttgccactagtgttggtataaaacactcaactggaatgagaaagtcagctccagttccaccagttcacactaaagcttagcatcccaggccatgggaattttttagcagagggattttaaaggtcttactagctataaaagattatttttgttattagctggtgcatcagataagaggtttattctttccattctaatcttcttatgcttccttctgtaataattctgctttactccatttctcatgtactaaaaactttagttataaactttgtaatgcaactctatattgtatctagtagaaaattattaaacatgaaaaagaccatttattcaacaaattttaagtaccaaatgaaaagccattatgctaagtagtagggccacgtaactccacatgaaagaaaaggaagatgaaaagaaagaaattccatgtctttaaggagattttaatctagtggaaagagaaaatggaaataaatataagtaatacaagataattgctacagtaaaattagaatgaagctggaacaggggtagaagggtgtcagtgatgccagagaaggatgtttagagcaccagaaacagtatggtgccatctcataagtaattggaaatacaagtaagcaaatatacaaacattttgtaaatgacatagacacttacgaaattaacatttctacatttttcttactttcggtatgcaagtgtgtgtgtctgcctacatgcttgtgccctaacacaagttagtctgcattttagtaaacccctgccttggggacgaaactagaggcagcaaagatattttaagtgtcctgaagtgagaggtgataactttaatcaggattagggcattggtgatagaaagaaggggacaaatacaaaagacagataagaataaataggattgaatgtgatagatgaaggatagagaggagtctggatgagcctaatttctggcttgaactgaatgaatagaacgaggaaaagtgggttcaggggacatgctgtgtttggatgcttatgcggcattcacccaaagcaggccaatgcgtggttagatatgaaatcgaagagaatgattggggtacatcagcatatagatatgtaaaaccaccttgggcacctgttcacagtgaaaagattgttgatcaaagatggaactctgattggatattataacttgaggggcaggtaaaggagatcctcatgctggaaaaaggaagaacagtcagaggggtaagaaagccaagagagagtagtgataaatgctaaaaaagaaagaaaggagtggtcagcagtaaacatcagttgcgcaataagaagaccaaaaagtgcccagtttggtcaagcggtcactggtgaacttacagcagtttcagcagagggagcagtaagcacagaagacgactaaaatgttgccaaataagcagacaatgggaagcagtgaaacagtagactgctgctcaggaaaaaaaaaaaagagagagagcgtgagaagcactatgacagaggaaccataatccaggaaggaatcctttcatgattatatacatcttcactggagaatatgtgttctgacagggagggactggagaatacaggtggagtaagtcagccttcacgagacaaagagtgcccaaagagtcctaccacagcacacccccagtgaaaggagaaaaagatagaaacagaaacatgtttatggtatgatgtgccagtagtgggtggcaggaagaagttgagacattgcaggataaagctgctcagttttcttgatgaggcaaaggagggtttatttgctgttggagaggtggtgctaggtgaataggggcttaaagggataatgtggaaataatcttgtttgagtaggaagaattaaagttttttaaataaattcttagattcaaaatgttttatatcctattgctttgttgttgccaaaatagtttatgccaaacagaaaatggcaaactgtatttttctttttcagatgattaaaggaaaagtgaaagctggaaaagtagactgtcaggcttatgctcagacatgccagaaagctgggatcagggcctatccaactgttaaattttatttctacgaaagagcaaaggtatgtccagactttcctctgttccttcccttagtaggccaagctcaaaagatgtgtttcagtctgagtaatgttttttttctgttttctcatccttgtcatttttttatattattacatattactgatacaagtttttaaaatttacatgtataccaagcgatcttaaaaggttttttgtcttgtggttgatacagactcaattgccttaacatttttatactaatgaataggaaaactactagaaagagacaaaaaaagtattattcgtgataatctttgagtgctggaattcaaggtaattttctacttttctgtgaaaggttatggtgactgttgaggtcactaagaatactctataatacacactgctgcttggaataatatttccttagtatatttctattcagtatactttttactgaataagtttcaaagtaatgagcttcctttgtggggaggaaagaacaatgataaagtatttgccatgtactcatgttttctggtaaaacattaaaaatagataatttcaaatatttttatactttttgtccagagcttatagcttgcagtgaatgccaagaatgagttctcagacaattccagctgaacgggggcaagatagctcttctaagagagtccaccccagcattcatccgcacagtatttattgaaagggcttgttaaaccacaaacatccactagatggcttgaggtccagtcgtgagacacctgtggccttgtaaaagcactcaaactgcattctcaggaggctgtttttagcgttccttatcacaccacacactccactcctgtcctgttttcgggatcaaggaatttcattctcatgcacaaataacatacacacagtgcctcagtatttttccatgccccgacctcaaatgccacgtacataaggttgaatatattgccatgctcccccgatgtctccctcttctttaattcttagcacatgctggtcatccaatgcaaggtaaacttctattgttcttccttggtcatagatacgttgggtggcagcacagagccgtctgcaaatgcctagcaaacagataaaaaaaagaataagtacaacggccatcacctaaatgcatatgtttaacccagacaaccaagtgttggggtttaaccaatgaaaactttcttgtaattgctgaagggtacttgtttgtagttgctgtgactattcttcaagttgttcaatttacactcaagagtggaaatttgagaagacaaatagtcgtgataagccccttgcagatgtgctttcactctctcccaagcatattgggagctattatatggcagaggtgtgacacagaattatattgccaatcacaatgtaaattttgacgggtaatgaatgcctgctgctgatcccctagccattcaaaagtggcttcaagggtctctaagtgagacaaaatagttttatcaatatttacctattcctgaaattcatgggttacattatataccatgtggcttatcactgaggctgtgtgaatagattctgtcagagaagcagttgcagtagcggcagttgctaatataataatagctgagagtaaaaaggcaactgaagtggccagaaatcttatttttcaagtatgagacaatgcttttctaaataggtgcagggtggaatcctcttcctagctccaagttaaatttacaggcagccaccattctgcatgccattttaagatcatgacacaggttatatttaattatgtaacgttttgatgagagaagcatgtagcataccaactactggaagagactttaatactataaaaggattgattctgctctatgttaggaacaccttgccgaaacaaaagtatataagggtgcatagtacaaatcaagactatgtcggtaacattattatgcagagagagggtatagttgccaccgctagtaatatactcaccatgggaaagaacccattcaaaaaaaggaagtcctaatctccaaatctgggtatgagcatggcttaaagcttgtttcccttttacttgtaatattggtcctaaaagcccatactctgaccagatgatagaactattggagggactcctaaatccaatagtctgatctgcagacataagattaccatggggaccctaatcaagtaaggtgtcattatcaaacagaggctcttgatgcagcgcaggctgtttgcatggcgaccactggatggcctcacacttatatcgccagtccgtactcagacagcatataggaagatcaggcacttgtgtagcttcattagagacctcagtaagattagtgctaacagcagacataaaggtcaagtttgcaaacttagtatccctttggggctggtaataaagatactcctgaagaatgagagtaacacacttatcatgtgctattatggggaaaaaaagggggattactagacaataaaatcaagtagtaattaagtttaatccatcccaaattttcagttaaggggtaagacaggggcatctatcaacctcctgtcccaaaagtatcattggatgacaaaggcaggtcagcatcccaccatgtaataacattaaaaacggggatttaaaacatgactccaataaacatgttcttgagctgatcccacttggcaaaggacaagaattgccagccaccccaacatccatgtttgtcttactttctcagaagtttccccagttaccaccagatacttaagaaaccgattccatgcggttgcgagggcttccacagctgcaagccaaatagatgcctgttgattcaatttctttagctgtccccaggtagtgttaggtgccttccaagtcatcaccttcattgttgtggtcgattctctaacaacaggtcctgttctcgaaaagagagccccatattccccgttttttgtttaagatatatattaagagtttgataagcttgtttaacaatggcttgactagttgaggtataaggaatactagttttgtgttgtatgtgctaaagttgcaatgcatatgcaaatcgagcactaagctagcaaggtctattatcaggttttatagtttgtggaaggtttaaagttataatggattcaaataaatgaccaattgcatctttagttttttttctggtctgggggtagcatgtattaggcctgtgtaagtgtacacggtaacgtggagaaatttaaaacgtttaaagggtggatactgagtaacatcagtttgccaaatagcattaggcaccagaccttgtaggttggcaccaagccttaaggaaaaaggggaaagagaatgctgttggcaatcaggacaagttttaataatcatgcgagcttgagcaagtgtcaaatgaaactgttgtttaagaatccaggcgttctgatgaaaaaaatcatgatcagctggactcgcaaaaaagcaggagaatctgcagaccacatctatggtcatactagagcatcaccttgagcattcttttctgataagggaccaggtagcttagaatgagagcgaatatgtatgatgtaaagagggtgatgatgggaccgaggagctcttgtgctggaagaaacaaagctagtaggggttcattagtaatgcccttcacatgtgcaagatttaaatgagtaatactatacaccatgtaagcagaatcactaactatatttatgtcttggtgaggaaaagttggttgcatgctgccttctaggttttatctcagatagctctggctttcttgctacccacagaggcctggggcaggagagttgctaagatgcaactaacttttccttatactccagggaagcagaaaaaagacacggccagaaaggctgatgctggaaataggaaatgagaacttgcatattaggaagactgtcataatcagccactttccttccctcctgtaggcacccctccagcagggaagtttgttgaggagacgcagccacctaatcatacaaatgttcgctgaccgggggtataatctaagaactgtcacttgggcggcctctaatctacttaagggggatgggaggtgctgttgcctgaacggggccaacagatgcaggtccctttaaggttggaggaaagaaaggcaatggcttttctgtagggggaggaaaaggctccagtctgtccttatcctcactagaaaaaatatactccttatgccctacagaagggaatcaagtagagagaggagcacccccgtgctgttctggttcctgtttttcctcactagaaaaaatctcttccttattccccatagaagggaatgaagcgtagagtggaatctctccctttaaatcttccaaattcctttcaggtggagataatgggcgatctggtgggtaaagaggataccacgcagagcgtaccggtgcccaggtggccaaaatagtagcgttaataaaatgaccttgctcatttcctcttttcaggcagtgacctacctgcttccataaccctaaatctaaggttccgtgatcaggaaaccaagggcatttctgccaaattaaaagcataagcttgtgtagagctccaggatctacagtgcactggatagccttaagtagctgttgcactgttttaaaaaatactttctgttctttggtcatttcctgacccatgataacccaacccctggtattttatgcatgggtcccatcctcctgatgggagtcaggactgtcccttactgggattcctcgaaaattgatgagctctcctccttcacacataacttcaaggtgatcacgtcgagggcaccacttgcagagcttatagcttgcagtgaatgccaagaatgagttctcagacaattacagctgagcagggccggtgagggggtggggggcagctcttctaagagagtccaccccagcatcatccgtccaccaagtatttattgaaagagcttgttaaaccacagatatccactagatggcttttttgaggtctggtcatgagacacctgtggccttgtaaaaatgctcaaactgcgtttcaggaggctgttttcagcattccttatcatactacacactacactccgtatcctgtttttagggtcaaggagttacattctcatgcacaaataacatacacacagtgcctcggtatttttccatgccccaacctcaaatgccatgtacatacgtatgaatatgttgccgtgtgccccccacattttgaaggagaattaggttaagatctgatgttatttattggtggttacattttgtgatgaatagggctaaattaagaaattggatgatgaatttcagaaatctagaattgccacacatctagatttttcagtgaaggtttttgatttgtcaagaatctgtcttaagaacaatctagagcaagcagaacttgatggaggtgagaggcagcttatatcagagcctgagtcttcatttctttgaatcaacagctctatttctcagttttcagaatagctgagagatgggtgacataaatagggatcttcttcagataatatcagagaagtatcaatttaatgagcagttacaagagttaaccataccatagacagagctgtttgaaaagatgttgccatgtgtccagaggagtccaggggacaaagttaggaaccaaacatccctgtccaaattgaaagacaagggtagcattcagccattgaggccagacaggaaggccaaagcagaataatggttggagtaaggagaaacacaaaccaggtgggcagttacacacaaaacaaaattctagcacatagttggggattagagttcacaccaagattaagacaacaggtggccccagatccaaataagcaggtcaggatatgctgacctgttccttcccctgcttttcagccaccttcctgctgtgcgcagatgaaaactaggagatacatgttgctttccattactgttgttggtcatggttgggcagtgctaatgattgtattagagtggaatgagttcggtcctctgggaacatctttttgtttgtttgttttaattatactctaagttctagtgtacatgcgcacaatgtgcaggtttgatacataggtatacatgtgtcgtgttggtttgctgcacccatcaactcatcatttacattaggtatttctcctaatgctatccctcccccagccctgaactccccaacaggccccagtatgtgatgttccccccactgtgtccaagtgatctcattgttcaattcccacctgtgagtgagaacatgagatgtttggttttctgtccttgtgatagtttgctgagaatgatggtttccagctacattcatgtccctgcaaaggacatgaacgcatccttttttatggctgcatagtattccatggtgtatatgtgccacattttcttaatccagtctatcattgatgtacttttgcggtggttccaggtctttgctattgtgaatagtgctgcagtaaacatatgtgtgcatgtgtctttatagtagcatgatttataatcctctgggtctatacccagtagtgggattgctgggtaaaatggtaattctaattctagatccttgaggaatcgccacactgtcttacacaatggttgaactaattaacactcccaccaacagtgtaaaagtgttcctgtttctccacatcctctccagcatctgttgtttcctgactttttaatgatcgccattctaactggtgtgagatggtatctcattgtggttttgatttgcatttctttgatgaccagtgatgatgagcattttttcatgcatctgttggctgcatagatgtcttcttttgagaagtgtctgttcatatcctttgcccactttttgatgggtttttttttattgtaaatttgtttgagttctttgtagattctggatattagccctttgtcagatgggtagattgccaacattttctcccattctgtaggttgcctttcactctgatgatagtttcttttgctgtgcagaagctctttagtttaattagatcccatttgtctattttggcttttgttgccattgcttttggtgttttcgtcatgaagtccttgcccatgcctatgtcctgaatggtattgcctaggttttcttctagggtttttatggttttagatcttacgtttaggtctttaatccatcttgaattaatttttgtataaggtgtaaggaagggatccagtttcacctttctacatatggctagccagttttctcagcaccatttattaaatagggtatccccattgcttgtttttgtcaggtttgtcaaagatcagatggttgtagatgtgtggtgttatttctgagggctctgttctgttccattggtctatatatctgttttggtaccagtaccatgctgttttggttactgtagccttgtagtatagtttgaagaaaggtactgtgatgcctccacctttgttctttttgcttaggattgtcttggcaatacgggctcttttttggttccatatgaaatttaaagtagtttttttcaattctgtaaggaaagtcattggtagcttgatggggatggaattgaatctataaattactttgggcagtatggccattttcacattattgattcttcctatccattagcatggaatattcttccatttgtttgtgtcctcttttatttccttgagtagtggtttgtagttctccttgaagaggtccttcacatcccttgtaagttggattcctaggtattttattctctttgtagcaattgtaaatgggagttcactcatgatttggctctctgttgatggtgtataggagtgcttgtgatttttgcacattgattttgtatcctgagactttgctgaagttccttatcagcttaaggagattttgggctgagatgatggggttttctaaataaacaatcatgtcatctgcatacagggacaatttgacttcctcatttcctaattgaataccctttatttctttttcttgcctaattgccctggccagaacttccaatactatgttgaataggagtggtgagagagggcgtccttgtattgtgctggttttcaaagggaatgcttccagtctttgcccattcagtataatattggctgtgggtttgtcatgaatagctcttattattttgagatacattccatcagtacctagtttattgagtttttagcatgaagggctgttgaattttgtcaaaggccttttctgcatctattgagataatcatgtagtttttgtctttggttctgtttatgtgaaggattacatttattgatttgcatatgttgaaccagccttgcatcccagggatgaagctgacttgatcttggtggataagctttttgatgtgctgctggattcagtttgccagtattttattgaggattttcacatcaatatttaggattttcacatcgatgttcatcagggatattggtctaaaattccctttttttgttgtgtctctgccaggctttggtatcaggatgatgttggcctcataaaatgagttagggaggattccctctgtttctattgattggaatagtttcagcaggaatggtaccagctcctctttgtagctctggtagaattcagctgtgaatccttctggtcctggactttttttggttgataggctattaattattgcctcaatttcagagcctgctattggtctattcagaaattcatcttcttcctggtttagtcttgggagggtgtttgtgtccaggaatttatccatttcttctagcttttctagtttatttgtgtagaggtgtttatagtattctctgatggtagtttgtatttctgtgggattggtggtgatatcccctttatcattttttattgcgtccatttgattcttctctcttttcctattagtcttgttagcagcctatcaattttgttgatcttttcaaaaaaccagctcctagattcattgattttttgaagggttttttatgtctctctttcagttctgctctgatcttagttatttcttgtcttctgctagcttttgaatttgtttgctcttgcttctccagttcttttaattgtgatgttagggtgtcaattttagatctttcctcatttctcctgtgggcatttagtgctataaatttccctctaaacactgctttagctgtgtcccagagattctggtatgttgtgtctttgttgccattggtttcaaagaacatctttatttctgccttcatttcgttatttacccagtagtcattcaggagtaggttgttcagtttccactagttgtgtggttttgagtgagtttcttaatcctgagttctaatttgattgcactgtggtctgagagacaatttgttgtgatttctgttgttttacatttgctgaggagtgttttgcttccaattatgttgtcaattttagaataagtgcagtgtagttctgagaagaatgtatattctgttgatttggggtggagagttctgtggttgtctattaggtctgctttttgcagagctgagtgcaagtcctggatatccttcttaaccttgtgtctcattgatctaatattaacagtgtggtgttaaagtctcccattattattgtgtgggagtctaagtgtctttgtaggtttctaaggacttactttatgaatctgggtgctcctgtattgggtccatatatatttaggatcgttagctcttcttgtggaattgatctctttaccattatgtaatagccttctttgtctctttgatctttgttggtttaaaatctgttttatcagagactaggattgcaacccatggtgttttgttttgttttgttttgttttgttttttggtttccatttgcttggtagatcttcctccatccctttattttgagcctgtgtgcatctttgcacatgagatgggtctcctgaatacagcacactgatgggtcttgactctttatcaaatttgccagcctgtgtcttttaattggggcatttagcccatttacatttaaggttaatattgttatgtgtgaatttgatcctgtcattatgatgttagctggttattttgcctgttaattgatgtagtttcttcatagcatcaatggtctttaccatttggcatgtttttgcaatggctggttccagttgtttcttcccaagtttagtgcttccttcaggagctcttgtaaggaaggcctggtggtgacaaaatcagcatttgcttgtctgtaaaggattttatttctccttcacttatgaagcttagtttggctggatatgaaattctgggttgaaaattcttttaagaatgttgaatattggcccccactatctcctggcttgtagggtttctgccgagagatctgctgttagtctgatgggcttccctttgagggtaactcgacctttctctctgcctgcccttaacattttttccttcatatcaaccttggtggatctgacaattatgtgtcttggggttgcttgtcttgaggagtatctttgtggtgttctctgtatttcctgaatttgaatgttggcctgccttgataggttgaggaagttctggataatatcctgaagagtgttttccaacttggttccattctccccatcactttcaagtacaccaatcaaacagatttggtctttccacagagtcccatatttcttggaggttttgttcatttctttttactctttttttctctaactttgtcttctcgctttatttcattaatttgatcttcaatcactgataccctttcttccacttgatcaaattggctattgaagcttgtgcatgtgtcaccaagttcttgtgccatggttttcaactccatcaggtcctttaaggtcttctctacactgtttattctagttagccattcgtctaatcttttttcaaggtttttagcttccttgcaatgggttcaaacatccttctttagctcagagaagtttgttattaccgaccttctgaagtctacttctgtcaactcatcaaagtcattctccgtccagctttgttccattgctggcgaggagctgcaatcctttggaggagaagaggcgctctgatttttagaatttttagcttttctgctctggtttctccccatctttgtggttttatctatctttggtctttgatgttggtgacctacagatggggttttggtgtagatgacctttttgttgatgctgatgctattcctttctgtttgttagttttccttctgacaggtccctcagctgcaggtctgttggagtttgctggaggtccactccagaccctgtttgcctgggtatcaccagcagaggctgcagaacagcaaatattgcagaacagcaaatattgctgcctgatgcttcctctggaagctttgtcccagaagggcagccgcctatatgaggtgtctgtcggcccctactggaaggtgtctcccagtcgggctacatggggatcagggactcacttgaagaggcagtctgtcccttctcagagctcaaatgccgttctgggagaaccaccactgtcttcagagctgtcagacaggaacgtttaagtctgcagaagttgtctgctgccttttgttcagctatgccctgccaacagaggtggattctagaggctgaaggccttgttgagctgtggtgggctccacccagtttgagcatccctttccactttgtttaccttctcaagcctccacaatggcagacacccctcccccagccaggctaccacctcacagttcaatcttagactgctgcactagcagtgagcaaggctccatgggtgtgggaccctctgagccaggcccaggagagaatctccttgtctgcagattgctaagaccttgggaaaagtgcagtatttgggcgagagtgtcccgttttttcaggtagtctgtcacggtttcccttggctaggaaagggaagtcccctaaccctttgcacttcccgggtgagacaacaccccccccaatccccgccctggcgtcttctcgccctctgtgggctgcacccactgtccaaccagtcccaatgagaagaaccagatacctcagttggaagtgcagaaatcacctgtcttctgtgttgatcacactaggagctgcagactggagctattcctactcagccatcttggaatgccctctcaaactttatccaggaacatctgttcttgcacagtttcgatgttttgaggcttttggagtcagtgatgcttttttttttttttttttaacaattgtttcatgtttccgtgacactattattagtatttattttaggtacattatgggttaactgcttttgcagcattatttccttgaagagaataaatttgaatttcaaacacttcaagttttggaacaaaagaacttgaaagcatatttaatcaagtttcttaggtggaaatgttatgtttttattaaatacttaaaagataacaagtgtttttaattttagagaaattttcaagaagagcagataaataccagagatgcaaaagcaatcgctgccttaataagtgaaaaattggaaactctccgaaatcaaggcaagaggaataaggtatggactaagcctagagttgactttggcaaaagttggcaaaagttagcaaaatctatttttcctatacattacatgcatccagagacaacaaaatgaggcatcaaaaaatagtaagatagctgaaaattctactttgggaaataggacaatcaaaatgtagcctagacactgaaatgcttttaaaaatttggacaagtaaaaccacttaacaaaaaatagtgactgtggtccatgcaaaaacatgtatacaaatatttatagctgtatcattcataatagcaaaaaaaagaaatgtctgtcaactgacagataaatgaaatgtggtgtatccattgaatagaatattttcagccataaaaggaatgaagtactgacctatgctacaacatgtttgaactctggaaaatgtttagtgaatgaagccagtcacaaaggccaaatattatataatactattgatgttaaatatctagaataatccatagggacagaacgtaggttaatggttgcctggggccgaagtggagtgggatagaaaagagcaaaaatggggtaactgctaatgggtagtaaggagtttattttgggaatatggaaaaatgttttaaaattagattgtaatgacagttggacaactctgaatataccaaaaaccactaaactcctttaaatgtgggaattttatggtatgtgaaatatatctcaacaaagccattaaaaaaaaaatagtgactgtggccataaattatttaaattttgttcaaatgtaaataaagcattgaattgttaggaataaatatactggagcctcataacacgttttgaatagcaaattttcttttgttcttggtgtaatcagaatgtattgaaacccatatttgtgttggcccctctttgaatctttaatctgtcaagaagcagcacaacctttttcctgttactcttcagaaggcagttcagttttacctttttcaaatcggtgttactgtagatcatacttaaaaacagaacaaagagtctatgaatgttgtagtgcttttaaaatggaatttaatacaatcacatgaggtatctcggattctttccctatgaggcgaaaggaggacaaaatagctcagcctctggaaagggctagagaagactggctttatagcaccatattagacaataggttctactgtaatccagttcaaactgcagaccccaatagacaaagccttacaacctacctcaagaatattttttacgaatctgaaaggtaggaaagagttatgagtctgtattttcttggttccactgaacaaacatgtttttctagtgtttcgctatattagttttctcaagatattttattttgaaaggtgtaacttttatctcattaaatatttgaaatttaaaaattgtcataatctaaaatatcatacctgaaattaagttaaagagaatacccaatatgcttgaaattatgtaaacctatatagttagtaatatctgctgtgagcaggtaagaactaggatattcttttcttttttattgttatattttggcaaagtatatttcatgtcatgatccattaaataagaatattgagtatttctgaaaaagtaaaatgttggtttgtggtatttcaccttatttttaacattaccaactcatactttctcctttctctatcgcctttacattattattataggatgaactttgataatgttgaagatgaagaaaaagtttaaaagaaattctgacagatgacatcagaagacacctatttagaatgttacatttatgatgggaatgaatgaacattatcttagacttgcagttgtactgccagaattatctacagcactggtgtaaaagaagggtctgcaaactttttctgtaaagggccggtttataaatattttagactttgcaggctataatatatggttcacacatgagaacaagaatagagtcatcatgtattctttgttatttgcttttaacaacctttaaaaaatattaaaacgattcttagctcagagccatacaaaagtaggctggattcagtccatggaccatagattgctgtccccctcgacggacttataatgtttcaggtggctggcttgaacatgagtctgctgtgctatctacataaatgtctaagttgtataaagtccactttcccttcacgttttttggctgacctgaaaagaggtaacttagtttttggtcacttgttctcctaaaaatgctatccctaaccatatatttatatttcgttttaaaaacacccatgatgtggcacagtaaacaaaccctgttatgctgtattattatgaggagattcttcattgttttctttccttctcaaaggttgaaaaaatgcttttaatttttcacagccgagaaacagtgcagcagtatatgtgcacacagtaagtacacaaatttgagcaacagtaagtgcacaaattctgtagtttgccgtatcatccaggaaaacctgagggaaaaaaattatagcaattaactgggcattgtagagtatcctaaatatgttatcaagtatttagagttctatattttaaagatatatgtgttcatgtattttctgaaattgctttcatagaaattttcccactgatagttgatttttgaggcatctaatatttacatatttgccttctgaactttgttttgacctgtatcctttatttacattgggtttttctttcgtagttttggtttttcactcctgtccagtctatttattattcaaataggaaaaattactttacaggttgttttactgtagcttataatgatactgtagttattccagttactagtttactgtcagagggctgcctttttcagataaatattgacataataactgaagttatttttataagaaaatcaagtatataaatctaggaaagggatcttctagtttctgtgttgtttagactcaaagaatcacaaatttgtcagtaacatgtagttgtttagttataattcagagtgtacagaatggtaaaaattccaatcagtcaaaagaggtcaatgaattaaaaggcttgcaactttttcaaaaacctgttagaatatgctttattgtgttttgaggagttttcctttttttcttttcaatatcactttatcctgctcaccagtatttcctcataagggttattatagccataattaatgttaaaatagactttgttcttcatattctcccatctttttcgctactatatactctgtctggattctgctgtatgcctgttggcatatatggaacagtcaccacttgtcacacttaacaccagctttttgaattatgatcagtaatggcaagagcctttcattctcgaatgtttaaagcctaggagttctacaaaattggcttctttctacaagaatcccaaaatggaatgcctaaagaagtcttacttgggtaaatacttactaaaatatactggttatgtgcatatcaccacactggacactgaggagtgttcaaaaggaatctaagacatggtccccatcttccaactgtctgtaattcactgttttgtcattgagctcataaggtacttacattactacctataaatgtttcctgtacttgttagttgttgagaaacattttaggcagtaaataaaatagtaaatattatgtgtcctataatttgacctaagctgtgtgcctttggaatcagctctaagccagggccccctgggagtcatgttaagaaacacgtatcataaagtgacatacatcaaggttatcttatatagtcataacagtattattgggtctttcaaaaacagctggcagattgagcttttaatggctatattgatacagtagatagagcacctctaaggagtaccaggtataatgtgccatttctctcagcaacaccatttttgtgtgcagctgaccctctaacatggtatcaattctagctgaccaaagcacattctatcaggcagccaggcttggaaattaggtccatttaaagtatgtggcttacagtcaggtatggtggtgtgcgcctattgtcccatctacttgagaggctgaggcaggagggattgcttgggctcaggattttgaatccagcctgggcaacatagcaagaccccatctctaataaataaattatgttttgggcattaa

SEQ ID NO: 528 - DNA, 4759 bp, Homo sapiens
tagttattaaagttcctatgcagctccgcctcgcgtccggcctcatttcctcggaaaatccctgctttccccgctcgccacgccctcctcctacccggctttaaagctagtgaggcacagcctgcggggaacgtagctagctgcaagcagaggccggcatgaccaccgagcagcgacgcagcctgcaagccttccaggattatatccggaagaccctggaccctacctacatcctgagctacatggccccctggtttagggaggaagaggtgcagtatattcaggctgagaaaaacaacaagggcccaatggaggctgccacactttttctcaagttcctgttggagctccaggaggaaggctggttccgtggctttttggatgccctagaccatgcaggttattctggactttatgaagccattgaaagttgggatttcaaaaaaattgaaaagttggaggagtatagattacttttaaaacgtttacaaccagaatttaaaaccagaattatcccaaccgatatcatttctgatctgtctgaatgtttaattaatcaggaatgtgaagaaattctacagatttgctctactaaggggatgatggcaggtgcagagaaattggtggaatgccttctcagatcagacaaggaaaactggcccaaaactttgaaacttgctttggagaaagaaaggaacaagttcagtgaactgtggattgtagagaaaggtataaaagatgttgaaacagaagatcttgaggataagatggaaacttctgacatacagattttctaccaagaagatccagaatgccagaatcttagtgagaattcatgtccaccttcagaagtgtctgatacaaacttgtacagcccatttaaaccaagaaattaccaattagagcttgctttgcctgctatgaaaggaaaaaacacaataatatgtgctcctacaggttgtggaaaaacctttgtttcactgcttatatgtgaacatcatcttaaaaaattcccacaaggacaaaaggggaaagttgtcttttttgcgaatcagatcccagtgtatgaacagcagaaatctgtattctcaaaatactttgaaagacatgggtatagagttacaggcatttctggagcaacagctgagaatgtcccagtggaacagattgttgagaacaatgacatcatcattttaactccacagattcttgtgaacaaccttaaaaagggaacgattccatcactatccatctttactttgatgatatttgatgaatgccacaacactagtaaacaacacccgtacaatatgatcatgtttaattatctagatcagaaacttggaggatcttcaggcccactgccccaggtcattgggctgactgcctcggttggtgttggggatgccaaaaacacagatgaagccttggattatatctgcaagctgtgtgcttctcttgatgcgtcagtgatagcaacagtcaaacacaatctggaggaactggagcaagttgtttataagccccagaagtttttcaggaaagtggaatcacggattagcgacaaatttaaatacatcatagctcagctgatgagggacacagagagtctggcaaagagaatctgcaaagacctcgaaaacttatctcaaattcaaaatagggaatttggaacacagaaatatgaacaatggattgttacagttcagaaagcatgcatggtgttccagatgccagacaaagatgaagagagcaggatttgtaaagccctgtttttatacacttcacatttgcggaaatataatgatgccctcattatcagtgagcatgcacgaatgaaagatgctctggattacttgaaagacttcttcagcaatgtccgagcagcaggattcgatgagattgagcaagatcttactcagagatttgaagaaaagctgcaggaactagaaagtgtttccagggatcccagcaatgagaatcctaaacttgaagacctctgcttcatcttacaagaagagtaccacttaaacccagagacaataacaattctctttgtgaaaaccagagcacttgtggacgctttaaaaaattggattgaaggaaatcctaaactcagttttctaaaacctggcatattgactggacgtggcaaaacaaatcagaacacaggaatgaccctcccggcacagaagtgtatattggatgcattcaaagccagtggagatcacaatattctgattgccacctcagttgctgatgaaggcattgacattgcacagtgcaatcttgtcatcctttatgagtatgtgggcaatgtcatcaaaatgatccaaaccagaggcagaggaagagcaagaggtagcaagtgcttccttctgactagtaatgctggtgtaattgaaaaagaacaaataaacatgtacaaagaaaaaatgatgaatgactctattttacgccttcagacatgggacgaagcagtatttagggaaaagattctgcatatacagactcatgaaaaattcatcagagatagtcaagaaaaaccaaaacctgtacctgataaggaaaataaaaaactgctctgcagaaagtgcaaagccttggcatgttacacagctgacgtaagagtgatagaggaatgccattacactgtgcttggagatgcttttaaggaatgctttgtgagtagaccacatcccaagccaaagcagttttcaagttttgaaaaaagagcaaagatattctgtgcccgacagaactgcagccatgactggggaatccatgtgaagtacaagacatttgagattccagttataaaaattgaaagttttgtggtggaggatattgcaactggagttcagacactgtactcgaagtggaaggactttcattttgagaagataccatttgatccagcagaaatgtccaaatgatatcaggtcctcaatcttcagctacagggaatgagtaactttgagtggagaagaaacaaacatagtgggtataatcatggatcgcttgtacccctgtgaaaatatattttttaaaaatatctttagcagtttgtactatattatatatgcaaagcacaaatgagtgaatcacagcactgagtattttgtaggccaacagagctcatagtacttgggaaaaattaaaaagcctcatttctagccttctttttagagtcaactgccaacaaacacacagtaatcactctgtacacactgggatagatgaatgaatggaatgttgggaatttttatctccctttgtctccttaacctactgtaaactggcttttgcccttaacaatctactgaaattgttcttttgaaggttaccagtgactctggttgccaaatccactgggcacttcttaaccttctatttgacctctgcgcatttggccctgttgagcactcttcttgaagctctccctgggcttctctctcttctagttctattctagtctttttttattgagtcctcctctttgctgatcccttccaagggttcaatatatatacatgtatatactgtacatatgtatatgtaactaatatacatacatacaggtatgtatatgtaatggttatatgtactcatgttcctggtgtagcaacgtgtggtatggctacacagagaacatgagaacataaagccatttttatgcttactactaaaagctgtccactgtagagttgctgtatgtagcaatgtgtatccactctacagtggtcagcttttagtagagagcataaaaatgataaaatacttcttgaaaacttagtttactatacatcttgccctattaatatgttctcttaacgtgtgccattgttctctttgaccattttcctataatgatgttgatgttcaacacctggactgaatgtctgttctcagatcccttggatgttacagatgaggcagtctgactgtcctttctacttgaaagattagaatatgtatccaaatggcattcacgtgtcacttagcaaggtttgctgatgcttcaaagagcttagtttgcggtttcctggacgtggaaacaagtatctgagttccctggagatcaacgggatgaggtgttacagctgcctccctcttcatgcaatctggtgagcagtggtgcaggcggggagccagagaaacttgccagttatataacttctctttggcttttcttcatctgtaaaacaaggataatactgaactgtaagggttagtggagagtttttaattaaaagaatgtgtgaaaagtacatgacacagtagttgcttgataatagttactagtagtagtattcttactaagacccaatacaaatggattatttaaaccaagtttatgagttggttttttttcattttctatttgtattttattaagagtgtcttttcttatgtgattttttttaattgctatttgatatggtttggctatatgtccccacccaaatctcatcttgaattataatccccatgtgtcaagggagggacctgacgggaggtgattggatcacgggggcagttgtccccatgctgttcttgggatagtgagttagttctcatgagatctgatggttttataagtgtttgacaattcctcctttacacacactctctctctcatctgctgccatgtaagacttgcctgcttccccttctgccatgattgtaagtttcctgaggcctcctcagccatgtggaactgtgaatctattaagcctcttttctttataaatgaaaa

SEQ ID NO: 529 - DNA, 4943 bp, Mus musculus
agtttcgatttcctatggccagccggctaggcagctttttcatcgggactccttggaaagtccccacttcgttcatctctggcggatttgcgggagccagggcgctcatcgatcgcctggagccacagaatgacagcggagcagcggcagaatctgcaagcattcagagactatatcaagaagattctggaccccacctacatcctcagctacatgagttcctggctcgaggatgaggaggtgcagtacattcaggctgagaagaacaacaagggcccaatggaagctgcctcactcttcctccagtacctgttgaagctgcagtcagagggctggttccaggcctttttggatgccctgtaccatgcaggttactgtggactttgtgaagccatcgaaagttgggactttcaaaaaattgaaaagttagaggaacacagattacttttaagacgtttagaaccagaatttaaggccacagttgatccaaatgatatcctttctgaactatccgaatgtttgattaatcaggaatgtgaagaaatcagacagatccgagacactaaagggagaatggcaggtgcggagaagatggccgaatgtcttatcagatccgacaaggaaaactggccaaaggtcttgcaacttgctttggagaaagacaacagcaagtttagtgaattgtggattgttgataaaggtttcaaaagggctgaaagcaaggctgatgaggatgatggagcggaggcgtccagcatccagattttcattcaggaagagccagagtgtcagaatctcagtcagaatcccgggcctccttcagaagcgtcttctaataatttacacagcccattgaaaccaagaaattaccaactggagcttgccctgcctgccaagaaagggaaaaatacaataatatgtgcccctactggttgtggaaaaacctttgtgtcgcttcttatatgtgaacaccatcttaaaaaattcccatgtggacaaaaagggaaagtggtcttcttcgctaaccaaattcctgtctatgagcagcaggcaactgtgttctcacgatattttgaaagacttgggtacaacattgcgagcatttctggggcaacatctgatagcgtctcagtgcagcacatcattgaagacaatgatatcatcatcctgacaccccagattcttgtgaacaatctcaacaacggagccatcccctcgttgtctgtcttcactctgatgatatttgatgagtgtcataacactagcaaaaaccacccatacaatcagatcatgttcagatacctagaccacaaacttggagagtcacgggacccactgcctcaggtcgttgggctgactgcctccgtcggcgttggagatgctaagaccgcggaggaagccatgcaacatatctgtaaactctgtgccgccctggatgcctccgtgattgccacagtcagagacaacgttgcagaactggaacaggtcgtttataagccccagaaaatttccaggaaagtggcatcccggacttcgaacacgtttaaatgcatcatctctcagctgatgaaggagacagagaagctagccaaggatgtctccgaggaacttggaaagctttttcaaattcaaaacagagaattcggcacccagaaatatgaacagtggattgtcggcgtccacaaagcgtgctcagtgtttcagatggcagacaaagaggaggagagccgggtctgcaaagcgctcttcctgtacacatcacatttgcggaaatacaacgatgcactcatcatcagtgaggatgcacagatgacagacgctctaaattacctcaaagccttcttccacgatgtccgagaagcagcattcgatgagaccgagcgagagcttactcggaggtttgaagaaaaactagaggaattagaaaaagtttccagggatcccagcaatgagaatcctaaactaagagacctctacttggtcttacaagaagagtaccacttaaagccagagaccaagaccattctcttcgtgaagaccagagcactcgtggatgctctgaagaaatggattgaagaaaatcctgcactaagctttctaaagcctggcatactgactgggcgtggcagaacaaaccgggcaacaggaatgacgctcccggcacagaagtgtgtgctggaggcattcagagccagcggagataacaatattctgattgctacctcggtcgctgatgaaggcattgacattgctgagtgcaatctcgtcattctctatgagtacgtgggcaacgtcatcaagatgatccaaaccagaggccgaggaagagcacgagatagcaagtgcttcctcctgaccagcagcgctgacgtgattgaaaaagaaaaggcgaacatgatcaaggaaaaaataatgaatgaatccatcttaagactgcagacatgggatgaaatgaaatttggaaagacggttcaccgcatacaggtgaatgaaaaactcctcagagacagtcagcacaaaccacaacctgttcctgacaaagaaaacaagaaactgctgtgtggaaagtgcaagaattttgcgtgctacacagctgacattcgagtggttgagacgtcccactacactgtccttggagacgcttttaaggagcgctttgtgtgtaagccacaccctaaaccaaagatctatgacaattttgagaagaaagcaaagatattctgcgccaaacagaactgtagccacgactggggaatttttgtgagatacaagacgttcgagattccagtcataaaaattgaaagtttcgtcgtggaagatattgtgagcggagttcagaaccggcactcaaagtggaaggactttcattttgaaaggatacagttcgatcctgcagaaatgtccgtatgacctcaggcttctccgtctcgtgccgcagggagccgtgccttaagcatggagttgatgagccaatgctttcttacccaagcttgcacaatcctttcttacacaagcctgcactgtgttgaatgccagataacctgactggttggtttcaagctggtgctgtccacacaaagcacacacgcctgaactgcggcgccgaatagtttcttcaccaataactcatagcgtagcccttggccatggtggggaggggttaaacttgtcccttttacacttttcagaactgcccgacagggaacgtgcagccactcggtacaccgagacgcatgatggctggcgtgctggaagggttcccgttctctgtctgctcgatctgctgtaagctgcctttgcccttaatgacagtgcccttaagaacagtgacttagttctttttcaggccaccagactgactgccagatcccttctgtcccttctgtcccttgcactgattcctttccggatttgaccctgccaccctgtcaccctctgcagagtctcctggtttctgtctcttccttggtttctttgctgactcaaatttggtagttgcaaggttcagtatgcacacatatatatttaaaatgacatataatttaaaatgtaaaagactatagttgacagctatgcttactgagatggtatttctgttctgttcattactatacatcttacccttgctctcatctgttcttttaacttgggccatttcccgtctttgaatagacatctcaaaccctgtctgtatgtctgtctgtttcccacctgtttgagacagggtctctctgtagaccagaaactccatatgtagactatgctggccttgaactcacagatccccctgcctctcaagtgttgaaattaaaatctttcaccatgcctggctctagctattttcaataaaggctcatgtttaaagtttgaactacttccaattcattccctgacgtggcttgttgttgttgtttacttttggagacactgttcctctctgtagccctggctgtgtagaccaggctgcccttggtcacagagatctgccagcttctgcctccggagcactgagattgaaggcctgcatcaccatgcctggcttgccctttcttcttaaacattatatattcaaatggcatttccgtgtttcttctcaaggtgtgccagtgcttcagagagcttagtttggggttcttcagatcaagagacaagtgtctgagcgctgttactgccaacagagcaaagtactcttcagttcagggaaggaacagtgctggttttgtaggcagtacagtggttttaacaccttcctagaacttacttgtaattcatcagttgtagaccatcaatggcctaaaccaaactgcagagatcatctgaccacataactccccttccaggacatttacatttgaagactatcccaagcccacccagagcacagtgggttacccaaactccccaggtcaaccctggaggtcaacagtatgacatgggatagcacaccacttctcacagatgcctagagaaattacccagcaacataactctttggggaaaaaacacctatagggattaggcttttaattgatagaataggtagaaaaaaagatatgtagtagttcttgatagtggttactggtaaaattcttagtgcaataaaatgaatttgccgagagctgactttcttttttttcttgtttttttgagacagggtttctctgtatagctttggctgtcctggaatgcactctgtagtccaggctggccttcgaactcagaaatccgccttcctctgcctcccaagtgttgggattaaaggcgtgcgccaccacgcctggctgagagctgactttcatttatgtcttttagtctatgttgcctttctttgctgctacagtttaagaactctacagcttgtataagatacctactggaaattatttgagaaaaaaaacttgtaaacattacaataatttaattaattaaaaatttatgtattt

SEQ ID NO: 530 - protein, 4 aa, Artificial Sequence
  synthetic
KDEL

SEQ ID NO: 531 - protein, 4 aa, Artificial Sequence
  synthetic
DEAD

The invention claimed is:

1. A method of selecting an optimal therapeutic treatment of cancer in a subject having a tumor, which method comprises:
a step of assessing in vitro the sensitivity of a cancer cell from the subject to a first treatment of cancer selected from a chemotherapy using a drug selected from an anthracyclin, a platin, an oxaliplatin, a taxane and an anti-mitotic agent, or radiotherapy, by determining the ability of the tumor cell to induce an anticancer immune response, the inability of the tumor cell to induce an anticancer immune response being indicative of a resistance of the subject to said first treatment of cancer and, if the subject is resistant to said first treatment of cancer, a step of selecting (i) a product allowing or enhancing the secretion of ATP, LysRS and/or IL-8, and/or the exposure of LysRS at the surface of a tumour cell, (ii) a product stimulating the autophagy machinery and/or an ER stress response, (iii) a product triggering the P2RX7 (P2X purinoceptor 7) and/or the NALP3 inflammasome, (iv) a product selected from an antihypertensive or cardiotropic drug or an apyrase inhibitor, or (v) any combination thereof, to be used in combination with the first treatment of cancer as the optimal therapeutic treatment of cancer for the subject.

2. The method according to claim 1, wherein the product stimulating the autophagy machinery is selected from an apyrase inhibitor, spermidin, resveratrol or rapamycin analogs and wherein the product stimulating an ER stress response is selected from digoxin, digitoxin, ouabain, strophantin, proscillaridin, sanguinarine or thapsigargin (THAPS).

* * * * *

UNITED STATES PATENT AND TRADEMARK OFFICE
CERTIFICATE OF CORRECTION

PATENT NO. : 8,828,944 B2
APPLICATION NO. : 13/642221
DATED : September 9, 2014
INVENTOR(S) : Laurence Zitvogel et al.

It is certified that error appears in the above-identified patent and that said Letters Patent is hereby corrected as shown below:

<u>On the Title Page, item (54) and in the Specification, Column 1, Title</u>
"COMPOUNDS AND USES THEREOF TO INDUCE AN IMMUNOGENIC CANCER CELL DEATH IN A SUBJECT" should read
--SELECTING THE OPTIMAL TREATMENT OF CHEMOTHERAPEUTICALLY RESISTANT CANCERS--.

In the Specification

<u>Column 7,</u>
Lines 50-51, "to IL-1,3-dependent" should read --to IL-1$\beta$-dependent--.

<u>Column 8,</u>
Line 10, "or TCR$\gamma^-$ T cells" should read --or TCR$\delta^-$ T cells--.

<u>Column 14,</u>
Line 48, "(D) Mays," should read --(D) Mavs,--.

<u>Column 58,</u>
Line 38, "and V74" should read --and V$\gamma$4--.

<u>Column 59,</u>
Line 23, "CD3E" should read --CD3$\epsilon$--.

<u>Column 64,</u>
Line 54, "cross-linking Indeed," should read --cross-linking. Indeed,--.

<u>Column 65,</u>
Line 56, "anti-CD3E" should read --anti-CD3$\epsilon$--.

Signed and Sealed this
Fourteenth Day of April, 2015

Michelle K. Lee
*Director of the United States Patent and Trademark Office*

CERTIFICATE OF CORRECTION (continued)

Column 71,
Line 29, "the A11c, dissipation" should read --the $\Delta\Psi_m$ dissipation--.
Line 56, "eIF2a" should read --eIF2α--.
Line 59, "eIF2a" should read --eIF2α--.

Column 79,
Line 22, "online" should read --online.--.

Column 83,
Line 52, "50n1)." should read --50μl).--.

Column 88,
Lines 23-37, "One million CT26 knock down with small interfering RNA specific for ATG5 or ATG7 or controls WT were treated with the anthracyclin mitoxanthrone (MTX) at 8 days post-implantation in one flank of a naive animal (BALB/C mouse). The lower graphs indicate that the growth of ATG5 and ATG7 deficient tumors are not controlled by MTX therapy in contrast to CT26 WT which significantly respond to anthracyclines. However, the upper graphs show that when apyrase inhibitors (AI) are co-administered locally in tumor beds along with chemotherapy (i.v. inoculated), tumors start to regress with the cytotoxic agent. Monitoring of tumor growth was recorded with a caliper (product of perpendicular diameters) and is depicted for 5 mice/group. Statistical analyses were performed with Anova test (Fisher's exact method) with significant results at p<0.05." should read
--One million CT26 knock down with small interfering RNA specific for ATG5, ATG6 (Beclin 1 BCN1), or ATG7 or controls siCO were treated with the anthracyclin mitoxanthrone (MTX) for 18 hours, washed and inoculated in one flank of a naïve animal (BALB/C mouse). Positive controls are CT26 treated with MTX and negative controls are CT26 treated with PBS. Ten days later, mice were rechallenged with 3x the minimal tumorigenic dose of live CT26 cells on the opposite flank and monitoring of tumor growth was recorded with a caliper (product of perpendicular diameters). The % of tumor free animals are shown in the graph and the number of animals per group is indicated (n=20). Statistical analyses were performed with Anova test (Fisher's exact method) with significant results at p<0.05.--.

Column 89,
Line 66, "Fink, L L1," should read --Fink, L. Li,--.

Column 90,
Line 41, "L. L1," should read --L. Li,--.

Column 91,
Line 47, "Z. L1," should read --Z. Li,--.

Column 92,
Line 47, "L1 W," should read --Li W,--.